US008124728B2

(12) United States Patent
O'Brien et al.

(10) Patent No.: US 8,124,728 B2
(45) Date of Patent: Feb. 28, 2012

(54) CA125 GENE AND ITS USE FOR DIAGNOSTIC AND THERAPEUTIC INTERVENTIONS

(75) Inventors: Timothy O'Brien, Little Rock, AR (US); John Beard, Little Rock, AR (US); Lowell Underwood, Fayetteville, AR (US)

(73) Assignee: The Board of Trustees of the University of Arkansas, Little Rock, AR (US)

( * ) Notice: Subject to any disclaimer, the term of this patent is extended or adjusted under 35 U.S.C. 154(b) by 1259 days.

(21) Appl. No.: 10/475,117

(22) Filed: Oct. 17, 2003

(65) Prior Publication Data
US 2007/0015907 A1    Jan. 18, 2007

Related U.S. Application Data

(63) Continuation-in-part of application No. PCT/US02/11734, filed on Apr. 12, 2002, and a continuation-in-part of application No. 09/965,738, filed on Sep. 27, 2001, now Pat. No. 7,309,760.

(60) Provisional application No. 60/284,175, filed on Apr. 17, 2001, provisional application No. 60/299,380, filed on Jun. 19, 2001, provisional application No. 60/345,180, filed on Dec. 21, 2001, provisional application No. 60/427,045, filed on Nov. 15, 2002.

(51) Int. Cl.
*C07K 14/00* (2006.01)
*C07K 14/435* (2006.01)
(52) U.S. Cl. ............... 530/350; 530/300; 530/324
(58) Field of Classification Search .............. None
See application file for complete search history.

(56) References Cited

U.S. PATENT DOCUMENTS

| 6,074,828 | A * | 6/2000 | Amara et al. ............. 435/6 |
|---|---|---|---|
| 6,335,194 | B1 | 1/2002 | Bennett et al. ........... 435/375 |
| 6,451,602 | B1 | 9/2002 | Popoff et al. ............ 435/375 |
| 6,468,546 | B1 * | 10/2002 | Mitcham et al. ......... 424/277.1 |
| 6,962,980 | B2 * | 11/2005 | Mitcham et al. ......... 530/387.1 |
| 7,205,142 | B2 * | 4/2007 | Lloyd et al. ............. 435/252.3 |
| 2002/0119158 | A1 * | 8/2002 | Algate et al. ............ 424/155.1 |
| 2003/0091580 | A1 * | 5/2003 | Mitcham et al. ......... 424/185.1 |
| 2003/0096238 | A1 * | 5/2003 | Salceda et al. ........... 435/6 |
| 2003/0143667 | A1 | 7/2003 | O'Brien et al. ........... 435/69.1 |
| 2004/0005579 | A1 * | 1/2004 | Birse et al. .............. 435/6 |
| 2004/0009474 | A1 * | 1/2004 | Leach et al. ............. 435/6 |
| 2004/0127401 | A1 | 7/2004 | O'Brien et al. |
| 2007/0015907 | A1 | 1/2007 | O'Brien et al. |

FOREIGN PATENT DOCUMENTS

| EP | 0288082 A | 10/1988 |
|---|---|---|
| EP | 1 074 617 A2 * | 2/2001 |
| WO | WO 94/25482 * | 11/1994 |
| WO | WO 96/34965 A1 * | 11/1996 |
| WO | WO 00/36107 A | 6/2000 |
| WO | WO/00/36107 A2 * | 6/2000 |
| WO | WO 00/58473 * | 10/2000 |
| WO | WO 01/42277 * | 6/2001 |
| WO | WO 01/92523 * | 6/2001 |
| WO | WO/01/70804 A1 * | 9/2001 |
| WO | WO 03/025148 A2 * | 9/2001 |
| WO | WO 01/75067 * | 10/2001 |
| WO | WO/02/06317 A2 * | 1/2002 |
| WO | WO 02/071928 * | 9/2002 |
| WO | WO 02/092836 * | 11/2002 |
| WO | WO 02/092836 A | 11/2002 |
| WO | WO 03/029271 A2 * | 4/2003 |

OTHER PUBLICATIONS

Roitt et al (1998, Immunology, 4th ed, Mosby).*
Holmes (Exp. Opin. Invest. Drugs, 2001, 10(3): 511-519).*
Greenspan et al.(Nature Biotechnology 7:936-937 (1999.*
Herbert et al. (The Dictionary of Immunology, Academic Press, 4th edition, 1995, p. 58).*
Bowie et al (Science, 1990, 257:1306-1310).*
Coleman et al. (Research in Immunology, 1994; 145(1): 33-36).*
Abaza et al. (Journal of Protein Chemistry, vol. 11, No. 5, 1992, pp. 433-444).*
Rudikoff et al. (PNAS, USA, 1982, 79: 1979-1983).*
Burgess et al (J of Cell Bio. 111:2129-2138, 1990).*
Isogai et al. (BAB14899 gi: 10436735 Sep. 29, 2000).*
Isoagai et al. (BAB14709, GI: 10435945, Sep. 29, 2000).*
Harlow and Lane (Antibodies: A Laboratory Manual, Cold Spring Harbor Laboratory, Cold Spring Harbor, NY, 1988, p. 76).*
Q9H7S7 (UniProt. Mar. 1, 2001).*
U.S. Appl. No. 10/715,066, filed Nov. 17, 2003, O'Brien, et al.
Base RC et al., "A Radioimmunoassay Using a Monoclonal Antibody to Monitor the Course of Epithelial Ovarian Cancer" N Engl J Med. 309:883-887 (1983).
Lloyd KO et al. "Isolation and Characterization of Ovarian Cancer Antigen CA125 Using A New Monoclonal Antibody (VK-8): Identification as a Ucin-Type Molecule" Int. J. Cancer, 71:842-850 (1997).
O'Brien, TJ et al. "More Than 15 Years of CA125: What is Known About The Antigen, Its Structure and Its Function" The International Journal of Biological Markers 13:188-655-649 (1988).
Yin, TWT et al. "Molecular Cloning of the CA125 Ovarian Cancer Antigen. Identification as a New Mucin (MUC16)" J Biol. Chem. 276:27371-27375 (2001).
O'Brien, et al. "The CA125 Gene: An Extracellular Superstructure Dominated by Repeat Sequences" Tumor Biology, vol. 22, 2001 pp. 348-366.

(Continued)

*Primary Examiner* — Peter J Reddig
(74) *Attorney, Agent, or Firm* — Hugh McTavish

(57) ABSTRACT

The CA125 gene has been cloned. The CA125 molecule comprises three major domains: an extracellular amino terminal domain; a large multiple repeat domain; and a carboxy terminal domain which includes a transmembrane anchor with a short cytoplasmic domain. Additionally, an amino terminal extension is present. The molecular structure is dominated by a repeat domain comprising more than sixty 156-amino-acid repeat units The repeat units encompass an interactive disulfide bridged C-enclosure and the site of OC125 and M11 binding. The CA125 molecule is anchored at its carboxy terminal through a transmembrane domain and a short cytoplasmic tail. The structure has potential for use as a new gold standard for detecting the CA125 antigen, and can provide a basis for the development of a vaccine useful for the treatment of ovarian cancer and other carcinomas where CA125 is elevated.

11 Claims, 20 Drawing Sheets

OTHER PUBLICATIONS

O'Brien, "The CA 125 Gene: A Newly Discovered Extension of the Glycosylated N-Terminal Domain Doubles the Size of This Extracellular Superstructure," Tumor Biology, 2002;23:154-169.
Ping Fu, et al., Rapid determination of transgene copy number in stably-transfected mammalian cells by competitive PCR, J. Biochem. Biophys. Methods 40 (1999) 101-112.
Nancy Shui-Fong Ma, et al., Monkey Gene Map: Evidence for a Homologous Human Chromosome 7q Region near the Cystic Fibrosis Locus, Academic Press, Inc. 1939, pp. 389-396.
O'Brien TJ et al., More than 15 years of CA125: what is known about the antigen, its structure and its function. International J. of Biological Markers 13:188-195, 1998.
Lloyd KO et al. Isolation and characterization of ovarian cancer antigen CA125 using a new . . . International J. Cancer 71:842-850, 1997.
Nap M et al. Immunohistochemical characterization of 22 monoclonal antibodies . . . Tumor Biol.: 17:325-331, 1996.
Desseyn J-L et al. J. Biol. Chem. 272:3168-78, 1997.
Chambers J et al., Genomics 38:305-313, 1996.
Genbank Accession No. AA640762, Oct. 27, 1997.
Tanaka, T et al., Efficient generation of antibodies to oncoproteins by using synthetic peptide antigens. Proc. Natl. Acad. Sci. USA 82:3400-3404, 1985.
O'Brien TJ et al., Tumor Biology 22:348-366, 2001.
O'Brien TJ et al. Tumor Biology 23:154-169, 2002.
Bast RC et al. New England J. Med. 309:883-887, 1983.
Bon GC et al. Am. J. Obstet. Gynecol. 174:107-114, 1996.
Clemons-Miller A et al. Clincal Cancer Research 7:917s-924s, Mar. 2001 (Suppl.).
Fendrick JL et al. Tumor Biol. 14:310-318, 1993.
Fendrick JL et al. Tmuor Biol. 18:278-289, 1997.
Foon KA et al., Clin. Cancer Research 7:1112-1115, 2001.
Gendler SJ et al., Annu. Rev. Physiol. 57:607-634, 1995.
Gum Jr., JR Am. J. Respir Cell Mol. Biol. 7:557-564, 1992.
Gum JR. Biochemical Society Transactions 23:795-599, 1995.
Hardardottir H et al., Am. J. Obstet. Gynecol. 163:1925-1931, 1990.
Konish I et al., J. Soc. Gynecol. Invest. 1:89-96, 1994.
Lloyd KO et al., Tumor Biol. 22:77-82, 2001.
Marshall E Science 292:1982-1983, 2001.
Goldsby, R et al., Kuby Immunology, 2000, W.H. Freeman and Company, New York, Chapter 3 Antigens, pp. 63-81.
Nustad K et al., Int. J. Biol. Markers 13:196-199, 1998.
Nustad K et al. Tumor Biology 17:196-219, 1996.
O'Brien TJ et al., Am. J. Obstet. Gynecol. 155:50-55, 1986.
O'Brien TJ et al., Am. J. Obstet. Gynecol. 165:1857-1864, 1991.
Quirk JG et al. Am. J. Obstet. Gynecol. 159:644-649, 1988.
Santin AD et al. Am. J. Obstet. Gynecol. 183:601-609, 2000.
Shigesmasa K et al. International J. of Gynecologic Cancer 7:296-303, 1997.
Shigesmasa K et al., J. Soc. Gynecol. Investigation 4:95-102 (1997).
Verma M et al., Glycoconjugate J. 11:172-179, 1994.
Wagner, U. et al. Hybridoma 16:33-40 (1997).
Wagner U et al., Clin. Cancer Res. 7:1112-1115, 2001.
Williams, SJ et al., J. Biol. Chem. 276:18327-18336, 2001.
Yin, TWT et al., J. Biol. Chem. 276:27371-27375, 2001.
Argueso et al.MUC16 mucin is expressed by the human ocular . . . Invest. Ophthalmol Vis. Sci 44:2487-95, 2003.
Coleman et al., Research in Immunology 145:33-36, 1994.
Abaza et al., J. Protein Chem. 11:433-444, 1992.
Rudikoff et al., Proc. Nat'l Acad. Sci. USA 79:1979-1983, 1982.
Burgess et al., J. Cell Biol. 111:2129-2138, 1990.
Ping Fu et al. J. Biochem. Biophys. Methods 40:101-112, 1999.
MA NS et al. Owl monkey gene map: evidence for a homologous human chromosome 7q region near cystic fibrosis locus, Genomics 5:389-396, 1989.
Zurawski VR et al.Tissue Distribution and characteristics of the CA125 antigen. Cancer Rev. 11-12:102-118, 1998.
Genbank accession No. AC016584, May 29, 2002.
Genbank accession No. AF361486, Sep. 8, 2003.
Genbank accession No. AF414442, Oct. 29, 2002.

* cited by examiner

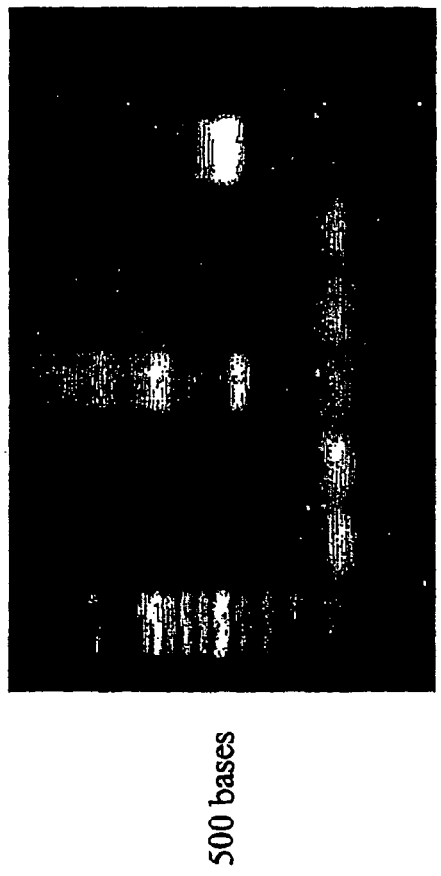
Figure 2

Figure 3 (SEQ ID NOS: 158, 159, 160, and 161)

Figure 5 (SEQ ID NO: 150)

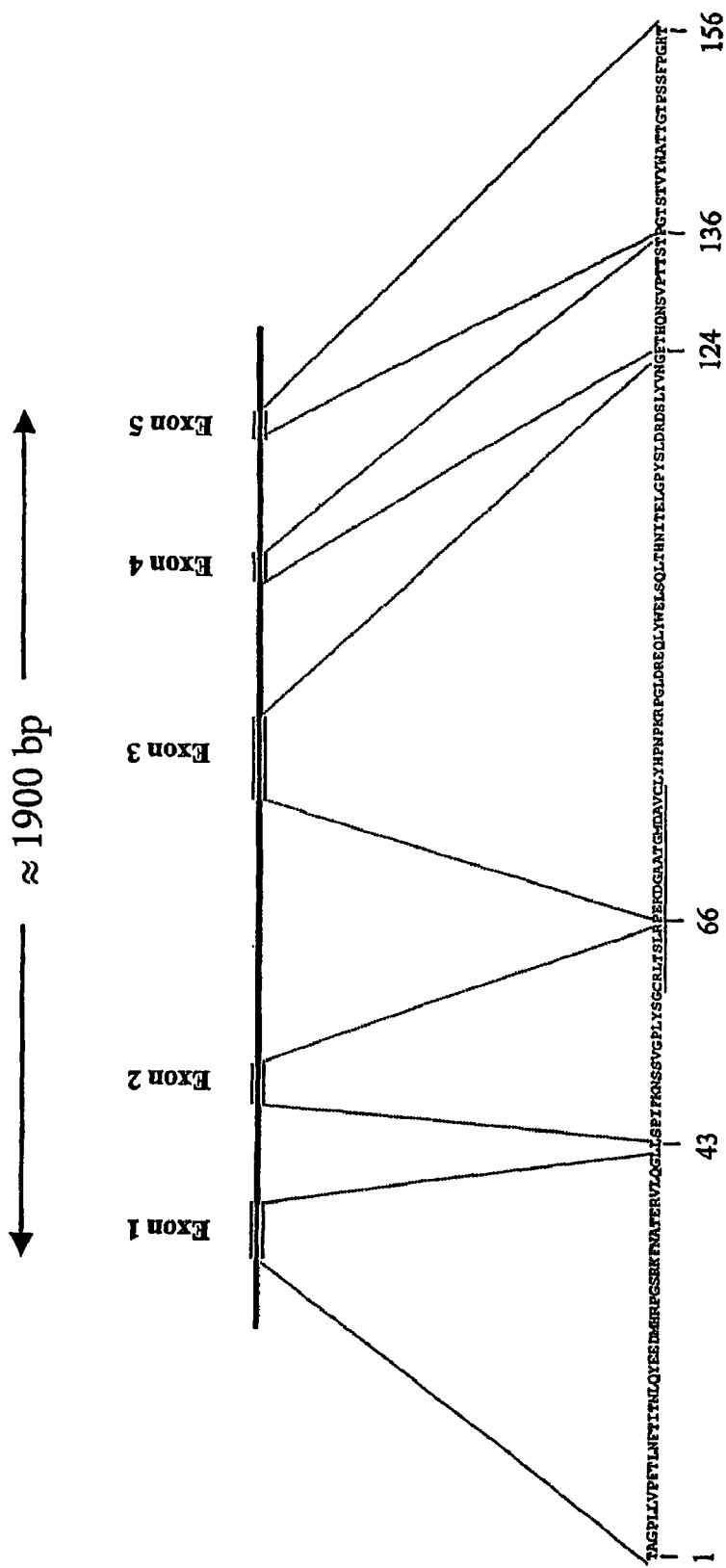
Figure 7B (SEQ ID NO: 163)

Exon 1

```
1                                          42
ATVPFMVPFTLNFTITNLQYEEDMRHPGSRKFNATERELQGL  (SEQ ID NO: 164)
TAVPLLVPFTLNFTITNLQYGEDMRHPGSRKFNTTERVLQGL  (SEQ ID NO: 165)
VPGPLLVPFTLNFTITNLQYEEAMRHPGSRKFNTTERVLQGL  (SEQ ID NO: 166)
APGPLLVPFTLNFTITNLQYEEDMRHPGSRKFSTTERVLQGL  (SEQ ID NO: 167)
APGPLLVPFTLNFTITNLQYEEDMRHPGSRKFNTTERVLQGL  (SEQ ID NO: 168)
APGPLLVPFTLNFTITNLQYEVDMRHPGSRKFNTTERVLQGL  (SEQ ID NO: 169)
SAGPLLVPFTLNFTITNLQYEEDMRHPGSRKFNTTERVLQGL  (SEQ ID NO: 170)
AAGPLLMPFTLNFTITNLQYEEDMRRTGSRKFNTMESVLQGL  (SEQ ID NO: 171)
TASPLLVLFTINCTITNLQYEEDMRRTGSRKFNTMESVLQGL  (SEQ ID NO: 172)
AAGPLLVPFTLNFTITNLQYGEDMGHPGSRKFNTTERVLQGL  (SEQ ID NO: 173)
TAGPLLIPFTLNFTITNLQYGEDMGHPGSRKFNTTERVLQGL  (SEQ ID NO: 174)
TAGPLLVPFTLNFTITNLQYGEDMGHPGSRKFNTTERVLQGL  (SEQ ID NO: 175)
TAGPLLVLFTLNFTITNLKYEEDMHRPGSRKFNTTERVLQTL  (SEQ ID NO: 176)
TAGPLLVPFTLNFTITNLQYEEDMHRPGSRKFNATERVLQGL  (SEQ ID NO: 177)
TAGPLLVPFTLNFTITNLQYEEDMHRPGSRRFNTTERVLQGL  (SEQ ID NO: 178)
TAGPLLVPFTLNFTITNLQYEEDMHRPGSRKFNTTERVLQGL  (SEQ ID NO: 179)
APVPLLIPFTLNFTITNLQYEEDMHRPGSRKFNTTERVLQGL  (SEQ ID NO: 180)
ATGPVLLPFTLNFTITNLQYEEDMHRPGSRKFNTTERVLQGL  (SEQ ID NO: 181)
AAGPLLVPFTLNFTITNLQYEEDMHHPGSRKFNTTERVLQGL  (SEQ ID NO: 182)
SAGPLLVPFTLNFTITNLQYEEDMHHPGSRKFNTTERVLQGL  (SEQ ID NO: 183)
TASPLLVLFTINFTITNQRYEENMHHPGSRKFNTTERVLQGL  (SEQ ID NO: 184)
TASPLLVLFTINFTITNLRYEENMHHPGSRKFNTTERVLQGL  (SEQ ID NO: 185)
EPGPLLIPFTFNFTITNLHYEENMQHPGSRKFNTTERVLQGL  (SEQ ID NO: 186)
EPGPLLIPFTFNFTITNLRYEENMQHPGSRKFNTTERVLQGL  (SEQ ID NO: 187)
APVPLLIPFTLNFTITNLHYEENMQHPGSRKFNTTERVLQGL  (SEQ ID NO: 188)
APVPLLIPFTLNFTITDLHYEENMQHPGSRKFNTTERVLQGL  (SEQ ID NO: 189)
AASPLLVLFTLNGTITNLRYEENMQHPGSRKFNTTERVLQGL  (SEQ ID NO: 190)
TAGPLLVPFTLNFTITNLKYEEDMHCPGSRKFNTTERVLQSL  (SEQ ID NO: 191)
AASHLLILFTLNFTITNLRYEENMW.PGSRKFNTTERVLQGL  (SEQ ID NO: 192)
TGVVSEEPFTLNFTINNLRYMADMGQPGSLKFNITDNVMKHL  (SEQ ID NO: 193)
AMGYHLKTLTLNFTISNLQYSPDMGKGSATFNSTEGVLQHLL  (SEQ ID NO: 194)
```

Figure 7C

Exon 2

```
43                    65
LKPLFRNSSLEYLYSGCRLASLR    (SEQ ID NO: 195)
LRPLFKNTSVSSLYSGCRLTLLR    (SEQ ID NO: 196)
LKPLFKNTSVGPLYSGCRLTLLR    (SEQ ID NO: 197)
LKPLFKSTSVGPLYSGCRLTLLR    (SEQ ID NO: 198)
LKPLFKSTSVGPLYSSCRLTLLR    (SEQ ID NO: 199)
LKPLFKNTSVGPLYSGCRLTSLR    (SEQ ID NO: 200)
LGPIFKNTSVGPLYSGCRLTSLR    (SEQ ID NO: 201)
LGPMFKNTSVGLLYSGCRLTLLR    (SEQ ID NO: 202)
LGPMFKNTSVGPLYSGCRLTLLR    (SEQ ID NO: 203)
LGPMFKNTSVGPLYSGCRLTSLR    (SEQ ID NO: 204)
LGPLFKNSSVGPLYSGCRLISLR    (SEQ ID NO: 205)
LGPLFKNSSVDPLYSGCRLTSLR    (SEQ ID NO: 206)
LSPIFKNSSVGPLYSGCRLTSLR    (SEQ ID NO: 207)
LSPIFKNTSVGPLYSGCRLTLLR    (SEQ ID NO: 208)
LSPLFQRSSLGARYTGCRVIALR    (SEQ ID NO: 209)
LRPLFKNTSVSSLYSGCRLTLLR    (SEQ ID NO: 210)
LRPLFKNTSVGPLYSGSRLTLLR    (SEQ ID NO: 211)
LRPLFKNTSIGPLYSSCRLTLLR    (SEQ ID NO: 212)
LRPLFKSTSVGPLYSGCRLTLLR    (SEQ ID NO: 213)
LRPVFKNTSVGLLYSGCRLTLLR    (SEQ ID NO: 214)
LRPVFKNTSVGPLYSGCRLTLLR    (SEQ ID NO: 215)
LRSLFKSTSVGPLYSGCRLTLLR    (SEQ ID NO: 216)
LRSLFKSTSVGPLYSGCRLTSLR    (SEQ ID NO: 217)
LTPLFKNTSVGPLYSGCRLTLLR    (SEQ ID NO: 218)
LTPLFRNTSVSSLYSGCRLTLLR    (SEQ ID NO: 219)
LMPLFKNTSVSSLYSGCRLTLLR    (SEQ ID NO: 220)
RPLFQKSSM.GPFYLGCQLISLR    (SEQ ID NO: 221)
```

Figure 7D

Exon 3

66                                                                                                    123

PEKDSSAMAVDAICTHRPDPEDLGLDRERLYWELSNLTNGIQELGPYTLDRNSLYVNG (SEQ ID NO: 222)
PEKDGAATGVDAICTHRLDPKSPGLNREQLYWELSKLTNDIEELGPYTLDRNSLYVNG (SEQ ID NO: 223)
PKKDGAATGVDAICTHRLDPKSPGLNREQLYWELSKLTNDIEELGPYTLDRNSLYVNG (SEQ ID NO: 224)
PEKDGTATGVDAICTHHPDPKSPRLDREQLYWELSQLTHNITELGHYALDNDSLFVNG (SEQ ID NO: 225)
PEKDGEATGVDAICTHRPDPTGPGLDREQLYLELSQLTHSITELGPYTLDRDSLYVNG (SEQ ID NO: 226)
PEKDGAATGMDAVCLYHPNPKRPGLDREQLYWELSQLTHNITELGPYSLDRDSLYVNG (SEQ ID NO: 227)
PEKDGAATGMDAVCLYHPNPKRPGLDREQLYCELSQLTHNITELGPYSLDRDSLYVNG (SEQ ID NO: 228)
PEKDGAATRVDAACTYRPDPKSPGLDREQLYWELSQLTHSITELGPYTLDRVSLYVNG (SEQ ID NO: 229)
PKKDGAATKVDAICTYRPDPKSPGLDREQLYWELSQLTHSITELGPYTQDRDSLYVNG (SEQ ID NO: 230)
PKKDGAATKVDAICTYRPDPKSPGLDREQLYWELSQLTHSITELGPYTQDRDSLYNVG (SEQ ID NO: 231)
PEKDGAATRVDAVCTHRPDPKSPGLDRERLYWKLSQLTHGITELGPYTLDRHSLYVNG (SEQ ID NO: 232)
PEKDGVATRVDAICTHRPDPKIPGLDRQQLYWELSQLTHSITELGPYTLDRDSLYVNG (SEQ ID NO: 233)
SEKDGAATGVDAICIHHLDPKSPGLNRERLYWELSQLTNGIKELGPYTLDRNSLYVNG (SEQ ID NO: 234)
SEKDGAATGVDAICTHRLDPKSPGLDREQLYWELSQLTNGIKELGPYTLDRNSLYVNG (SEQ ID NO: 235)
SEKDGAATGVDAICTHRLDPKSPGVDREQLYWELSQLTNGIKELGPYTLDRNSLYVNG (SEQ ID NO: 236)
SEKDGAATGVDAICTHRVDPKSPGVDREQLYWELSQLTNGIKELGPYTLDRNSLYVNG (SEQ ID NO: 237)
SEKDGAATGVDAICTHHLNPQSPGLDREQLYWQLSQMTNGIKELGPYTLDRNSLYVNG (SEQ ID NO: 238)
PEKRGAATGVDTICTHRLDPLNPGLDREQLYWELSKLTRGIIELGPYLLDRGSLYVNG (SEQ ID NO: 239)
PEKNGAATGMDAICSHRLDPKSPGLNREQLYWELSQLTHGIKELGPYTLDRNSLYVNG (SEQ ID NO: 240)
PEKNGAATGMDAICSHRLDPKSPGLDREQLYWELSQLTHGIKELGPYTLDRNSLYVNG (SEQ ID NO: 241)
PEKHGAATGVDAICTLRLDPTGPGLDRERLYWELSQLTNSVTELGPYTLDRDSLYVNG (SEQ ID NO: 242)
PEKHGAATGVDAICTLRLDPTGPGLDRERLYWELSQLTNSITELGPYTLDRDSLYVNG (SEQ ID NO: 243)
PEKHEAATGVDTICTHRVDPIGPGLDRERLYWELSQLTNSITELGPYTLDRDSLYVNG (SEQ ID NO: 244)
PEKQEAATGVDTICTHRVDPIGPGLDRERLYWELSQLTNSITELGPYTLDRDSLYVNG (SEQ ID NO: 245)
PEKQEAATGVDTICTHRVDPIGPGLDRERLYWELSQLTNSITELGPYTLDRDSLYVDG (SEQ ID NO: 246)
PEKDKAATRVDAICTHHPDPQSPGLNREQLYWELSQLTHGITELGPYTLDRDSLYVDG (SEQ ID NO: 247)
SVKNGAETRVDLLCTYLQPLSGPGLPIKQVFHELSQQTHGITRLGPYSLDKDSLYLNG (SEQ ID NO: 248)
PEKDGAATGVDTTCTYHPDPVGPGLDIQQLYWELSQLTHGVTQLGFYVLDRDSLFING (SEQ ID NO: 249)

Figure 7E

Exon 4

124      135

| | |
|---|---|
| FTHRSSMPTTST | (SEQ ID NO: 250) |
| FTHRSSMPTTSI | (SEQ ID NO: 251) |
| FTHRTSVPTSST | (SEQ ID NO: 252) |
| FTHRTSVPTTST | (SEQ ID NO: 253) |
| FTHRSSVPTTSS | (SEQ ID NO: 254) |
| FTHRSSVSTTST | (SEQ ID NO: 255) |
| FTHRSSVAPTST | (SEQ ID NO: 256) |
| FTHRSSGLTTST | (SEQ ID NO: 257) |
| FTHRSFGLTTST | (SEQ ID NO: 258) |
| FTHRSSFLTTST | (SEQ ID NO: 259) |
| FTHRNFVPITST | (SEQ ID NO: 260) |
| FTHRSSVPTTSI | (SEQ ID NO: 261) |
| FTHQSSVSTTST | (SEQ ID NO: 262) |
| FTHQTSAPNTST | (SEQ ID NO: 263) |
| FTHQTFAPNTST | (SEQ ID NO: 264) |
| FTHQNSVPTTST | (SEQ ID NO: 265) |
| FTHQSSMTTTRT | (SEQ ID NO: 266) |
| FTHWIPVPTSST | (SEQ ID NO: 267) |
| FTHWSPIPTTST | (SEQ ID NO: 268) |
| FTHWSSGLTTST | (SEQ ID NO: 269) |
| FHPRSSVPTTST | (SEQ ID NO: 270) |
| FNPRSSVPTTST | (SEQ ID NO: 271) |
| FNPWSSVPTTST | (SEQ ID NO: 272) |
| FTQRSSVPTTSI | (SEQ ID NO: 273) |
| FTQRSSVPTTST | (SEQ ID NO: 274) |
| FTQRSSVPTTSV | (SEQ ID NO: 275) |
| YNEPGLDEPPTT | (SEQ ID NO: 276) |
| YAPQNLSIRGEY | (SEQ ID NO: 277) |

Exon 5

136                156

| | |
|---|---|
| PGTSTVDVGTSGTPSSSPSPT | (SEQ ID NO: 278) |
| PGTSTVDLRTSGTPSSLSSPTIM | (SEQ ID NO: 279) |
| PGTSTVDLGTSGTPFSLPSPA | (SEQ ID NO: 280) |
| PGTSTVDLG.SGTPSSLPSPT | (SEQ ID NO: 281) |
| PGTSTVDLG.SGTPSLPSSPT | (SEQ ID NO: 282) |
| PGTSTVDLGTSGTPSSLPSPT | (SEQ ID NO: 283) |
| PGTPTVDLGTSGTPVSKPGPS | (SEQ ID NO: 284) |
| PWTSTVDLGTSGTPSPVPSPT | (SEQ ID NO: 285) |
| PGTSTVYWATTGTPSSFPGHT | (SEQ ID NO: 286) |
| PGTSTVHLATSGTPSSLPGHT | (SEQ ID NO: 287) |
| PGTSTVHLATSGTPSPLPGHT | (SEQ ID NO: 288) |
| PDTSTMHLATSRTPASLSGPT | (SEQ ID NO: 289) |
| PGTSAVHLETSGTPASLPGHT | (SEQ ID NO: 290) |
| PGTSAVHLETTGTPSSFPGHT | (SEQ ID NO: 291) |
| PGTSTVHLGTSETPSSLPRPI | (SEQ ID NO: 292) |
| PGTSIVNLGTSGIPPSLPETT | (SEQ ID NO: 293) |
| PGTFTVQPETSETPSSLPGPT | (SEQ ID NO: 294) |
| PGTPTVDLGTSGTPVSKPGPS | (SEQ ID NO: 295) |
| PGTPTVYLGASKTPASIFGPS | (SEQ ID NO: 296) |
| PKPATTFLPPLSEATT..... | (SEQ ID NO: 297) |
| QINFHIVNWNLSNPDPTSSEY | (SEQ ID NO: 298) |

Figure 7F

```
  1 MEHITKIPNE AAHRGTIRPV KGPQTSISPA SPKGLHTGGT KRMETTTAL
 51 KTTTTALKTT SRATLTTSVY TPTLGTLTPL NASRQMASTI LTEMMITTPY
101 VFPDVPETTS SLATSLGAET STALPRTTPS VLNRESETTA SLVSRSGAER
151 SPVIQTLDVS SSEPDTTASW VIHPAETIPT VSKTTPNFFH SELDTVSSTA
201 TSHGADVSSA IPTNISPSEL DALTPLVTIS GTDTSTTFPT LIKSPHETET
251 RTTWLTHPAE TSSTIPRTIP NFSHHESDAT PSLATSPGAE TSSAIPIMTV
301 SPGAEDLVTS QVTSSGTDRN MTIPTLTLSP GERKTIASLV THPEAQTSSA
351 IPTSTISPAV SRLVTSMVTS LAAKTSTTNR ALTNSPGEPA TTVSLVTHPA
401 QTSPTVPWTT SIFFHSKSDT TPSMTTSHGA ESSSAVPTPT VSTEVPGVVT
451 PLVTSSRAVI STTIPILTLS PGEPETTPSM ATSHGEEASS AIPTPTVSPG
501 VPGVVTSLVT SSRAVTSTTI PILTESLGEP ETTPSMATSH GTEAGSAVPT
551 VLPEVPGHVT SLVASSRAVT STTLPTLTLS PGEPETTPSM ATSHGAEASS
601 TVPTVSPEVP GVVTSLVTSS SGVNSTSIPT LIISPGELET TPSMATSHGA
651 EASSAVPTPT VSPGVSGVVT PLVTSSRAVT STTIPILTLS SSEEETTPSM
701 ATSHGVEASS AVLTVSPEVP GMVTSLVTSS RAVTSTTIPT LTIISDEPET
751 TTSLVTHSSA KMISAIPTLA VSPTVQGLVT SLVTSSGSET SAFSNLTVAS
801 SQPETIDSWV AHPGTEASSV VPTLTVSTGE PTNISLVTH PAESSSTLPR
851 TTSRFSHSEL DTMPSTVTSP EAESSSAIST TISPGIPGVL TSLVTSSGRD

901 ISATEPTVPE SPHESEATAS WVTHPAVTST TVPRTTPNYS RSEPDTTPSI
951 ATSPGAEATS DEPTITVSPD VPDMVTSQVT SSGTDTSITI PTLTLSSGEP
1001 ETTSFITYS ETHTSSAIPT LPVSPGASKM LTSLVISSGT DSTTTFPTLT
1051 ETPYEPETTA IQLIHPAETN TMVPRTTPKE SHSKSDTTLP VAITSPGPEA
1101 SSAVSTTIS PDMSDLVTSL VPSSGTDTST TFPTLSETPY EPETTATWLT
1151 HPAETSTVS GTIPNESHRG SDTAPSMVTS PGVDTRSGVP TTTIPPSIPG
1201 VVTSQVTSSA TDTSTAIPTL TPSPGEPETT ASSATHPGTQ TGETVPIRTV
1251 PSSEPDTMAS WVTHPPQTST PVSRTTSSES HSSPDATPVM ATSPRTEASS
1301 AVLTTISPGA PEMVTSQITS SGAATSTTVP TLTHSPGMPE TTALLSTHPR
1351 TETSKTFPAS TVFPQVSETT ASLTIRPGAE TSTALPTQTT SSLFTLLVTG
1401 TSRVDLSPTA SPGVSAKTAP LSTHPGTETS TMIPTSTLSL GLLETTGLLA
1451 TSSSAETSTS TLTLTVSPAV SGLSSASITI DKPQTVTSWN TETSPSVTSV
1501 GPPEFSRTVT GTTMTLIPSE MPTPPKTSHG EGVSPTTILR TTMVEATNLA
1551 TTGSSPTVAK TTTTNTLAG SLFTPLTTPG MSTLASESVT SRTSYNHRSW
1601 ISTTSSYNRR YWTPATSTPV TSTESPGIST SSIPSSTAAT VPEMVPFTLN
1651 FTITNLQYEE DMRHPGSRKF NATERELQGL LKPLFRNSSL EYLYSGCRLA
1701 SLRPEKDSSA MAVDAICTHR PDPEDLGLDR ERLYWELSNL TNGIQELGPY
1751 TLDRNSLYVN GFTHRSSMPT SSTPGTSTVD RSTPGTSTVD VGTSGTPSSS PSPT
```

Figure 8B (SEQ ID NO: 299)

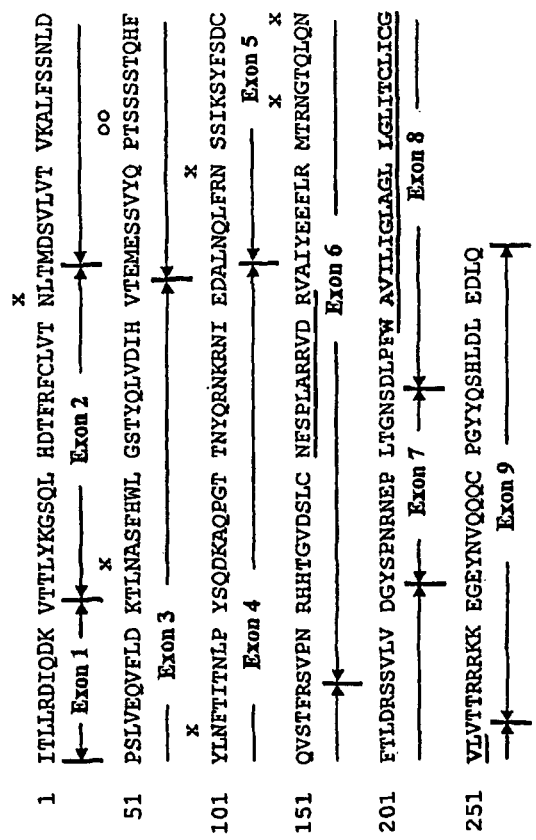
Figure 9B (SEQ ID NO: 300)

CA125 GENE AND ITS USE FOR DIAGNOSTIC AND THERAPEUTIC INTERVENTIONS

This application is a continuation-in-part of PCT/US02/11734 filed Apr. 12, 2002. This application claims the benefit of U.S. Provisional Application Ser. No. 60/284,175 filed Apr. 17, 2001, U.S. Provisional Application Ser. No. 60/299,380 filed Jun. 19, 2001, and U.S. Provisional Application Ser. No. 60/345,180 filed Dec. 21, 2001 through PCT/US02/11734, and is a continuation-in-part of U.S. application Ser. No. 09/965,738, now U.S. Pat. No. 7,309,760, filed Sep. 27, 2001, through PCT/US02/11734. This application is a continuation-in-part of provisional application 60/427,045 (filed Nov. 15, 2002). All of these cited applications are hereby specifically incorporated by reference. Applicant hereby specifically claims the benefit of these prior filed applications under 35 U.S.C. §§119(e), 120 and 363.

BACKGROUND OF THE INVENTION

The present invention relates generally to the cloning, identification, and expression of the CA125 gene's glycosylated amino terminal domain, the multiple repeat domain, and the carboxy terminal domain in vitro and, more specifically, to the use of recombinant CA125 with epitope binding sites for diagnostic and therapeutic purposes. Additionally, the genomic DNA, a molecule encoding a 5' upstream region of CA125 and a genomic DNA sequence for the amino terminal, extra cellular repeats and carboxy terminal of CA125 has been determined.

CA125 is an antigenic determinant located on the surface of ovarian carcinoma cells with essentially no expression in normal adult ovarian tissue. Elevated in the sera of patients with ovarian adenocarcinoma, CA125 has played a critical role for more than 15 years in the management of these patients relative to their response to therapy and also as an indicator of recurrent disease.

It is well established that CA125 is not uniquely expressed in ovarian carcinoma, but is also found in both normal secretory tissues and other carcinomas (i.e., pancreas, liver, colon) [Hardardottir H et al., Distribution of CA125 in embryonic tissue and adult derivatives of the fetal periderm, *Am J Obstet. Gynecol.* 163; 6(1):1925-1931 (1990); Zurawski V R et al., Tissue distribution and characteristics of the CA125 antigen, *Cancer Rev.* 11-12:102-108 (1988); and O'Brien T J et al., CA125 antigen in human amniotic fluid and fetal membranes, *Am J Obstet. Gynecol.* 155:50-55, (1986); Nap M et al., Immunohistochemical characterization of 22 monoclonal antibodies against the CA125 antigen: 2nd report from the ISOBM TD-1 workshop, Tumor Biology 17:325-332 (1996)]. Notwithstanding, CA125 correlates directly with the disease status of affected patients (i.e., progression, regression, and no change), and has become the "gold standard" for monitoring patients with ovarian carcinoma [Bast R C et al., A radioimmunoassay using a monoclonal antibody to monitor the course of epithelial ovarian cancer, *N Engl J Med.* 309:883-887 (1983); and Bon G C et al., Serum tumor marker immunoassays in gynecologic oncology: Establishment of reference values, *Am J Obstet. Gynecol.* 174:107-114 (1996)]. CA125 is especially useful in post-menopausal patients where endometrial tissue has become atrophic and, as a result, is not a major source of normal circulating CA125.

During the mid 1980's, the inventor of the present invention and others developed M11, a monoclonal antibody to CA125. M11 binds to a dominant epitope on the repeat structure of the CA125 molecule [O'Brien T J et al., New monoclonal antibodies identify the glycoprotein carrying the CA125 epitope, *Am J Obstet Gynecol* 165:1857-64 (1991)]. More recently, the inventor and others developed a purification and stabilization scheme for CA125, which allows for the accumulation of highly purified high molecular weight CA125 [O'Brien T J et al., More than 15 years of CA125: What is known about the antigen, its structure and its function, *Int J Biological Markers* 13(4):188-195 (1998)].

Considerable progress has been made over the years to further characterize the CA125 molecule, its structure and its function. The CA125 molecule is a high molecular weight glycoprotein with a predominance of O-linked sugar side chains. The native molecule exists as a very large complex (~2-5 million daltons). The complex appears to be composed of an epitope containing CA125 molecule and binding proteins which carry no CA125 epitopes. The CA125 molecule is heterogenous in both size and charge, most likely due to continuous deglycosylation of the side chains during its lifespan in bodily fluids. The core CA125 subunit is in excess of 200,000 daltons, and retains the capacity to bind both OC125 and M11 class antibodies.

Despite the advances in detection and quantitation of serum tumor markers like CA125, the majority of ovarian cancer patients are still diagnosed at an advanced stage of the disease—Stage III or IV. Further, the management of patients' responses to treatment and the detection of disease recurrence remain major problems. There, thus, remains a need to significantly improve and standardize current CA125 assay systems. Further, the development of an early indicator of risk of ovarian cancer will provide a useful tool for early diagnosis and improved prognosis.

SUMMARY OF THE INVENTION

The genomic DNA and a full-length cDNA sequence of human CA125 has been determined. Additionally, a nucleic acid molecule encoding a 5' upstream region of the CA125 gene has been determined.

The genomic sequence for CA125 and a 5' upstream region has been determined. A DNA sequence showing the 5' upstream region and the amino terminal portion of the CA125 molecule is set out in Table 27. The extracellular amino terminal domain is made of exons: Exon 1 from 2205-11679; Exon 2 from 13464-13570; Exon 3 from 16177-34419; Exon 4 from 34575-38024; Exon 5 from 38689-38800; Exon 6 from 40578-45257; Exon 7 from 47360-47395; Exon 8 from 52407-52442; Exon 9 from 52686-52744 as set out in SEQ ID NO 311. A DNA sequence showing the extracellular repeat portion of the CA125 molecule is set out in Table 28. The repeat portion is made of exons: Exon R1 from 1-130; Exon R2 from 442-510; Exon R3 from 5479-5652; Exon R4 from 6301-6334; Exon R5 from 6593-6657; Exon R1 from 7558-7683; Exon R2 from 8216-8284; Exon R3 from 8877-9050; Exon R4 from 9380-9413; Exon R5 from 9675-9739; Exon R1 from 10201-10291; Exon R2 from 10524-10592; Exon R3 from 11200-11373; Exon R4 from 11722-11755; Exon R5 from 12016-12036; Exon R1 from 12169-12295; Exon R2 from 12532-12600; Exon R3 from 13219-13392; Exon R4 from 13723-13756; Exon R5 from 14016-14077; Exon R1 from 15001-15126; Exon R2 from 15367-15435; Exon R1 from 15648-15773; Exon R2 from 16002-16070; Exon R3 from 16653-16826; Exon R4 from 17158-17191; Exon R5 from 17453-17517; Exon R1 from 18532-18657; Exon R2 from 18888-18956; Exon R3 from 19633-19806; Exon R4 from 20141-20176; Exon R5 from 20387-20449; Exon R1 from 21609-21731; Exon R2 from 21940-22008; Exon R3 from 22605-22778; Exon R4 from 23109-23142; Exon R1 from 29046-29168; Exon R2 from 29266-29334; Exon R3 from 33917-34090; Exon R4 from 36702-36734; Exon R5 from 38270-38320; Exon R1 from 39104-39224; Exon R2 from 39315-39383; Exon R3 from 39532-39705; Exon R4 from 41862-41992 as set out in SEQ ID NO 312. A DNA sequence showing the carboxy terminal domain of the CA125 molecule is set out in Table 29. The carboxy terminal portion is made of exons: Exon C1 from 1-66; Exon C2 from 1802-1947; Exon C3 from 4198-4350; Exon C4 from 4679-4747; Exon C5 from 6811-6978; Exon C6 from 11232-11270; Exon C7 from 11594-11677; Exon C8 from 14095-14187 as set out in SEQ ID NO 313. A full length cDNA molecule for CA125 is set out in Table 30 and SEQ ID NO 314. A CA125 protein is set out in Table 31 and SEQ ID NO 315.

The CA125 gene has been cloned and multiple repeat sequences as well as the glycosylated amino terminal and the carboxy terminus have been identified. CA125 requires a transcript of more than 35,000 bases and occupies approximately 150,000 bp on chromosome 19q 13.2. The CA125 molecule comprises three major domains: an extracellular amino terminal domain (Domain 1); a large multiple repeat domain (Domain 2); and a carboxy terminal domain (Domain 3) which includes a transmembrane anchor with a short cytoplasmic domain. The amino terminal domain is assembled by combining five genomic exons, four very short amino terminal sequences and one extraordinarily large exon. This domain is dominated by its capacity for O-glycosylation and its resultant richness in serine and threonine residues. Additionally, an amino terminal extension is present, which comprises four genomic exons. Analysis of the amino terminal extension revealed that its amino acid composition is consistent with the amino acid composition of the amino terminal domain.

The extracellular repeat domain, which characterizes the CA125 molecule, also represents a major portion of the CA125 molecular structure. It is downstream from the amino terminal domain and presents itself in a much different manner to its extracellular matrix neighbors. These repeats are characterized by many features including a highly-conserved nature and uniformity in exon structure. But most consistently, a cysteine enclosed sequence may form a cysteine loop. Domain 2 comprises 156 amino acid repeat units of the CA125 molecule. The repeat domain constitutes the largest proportion of the CA125 molecule. The repeat units also include the epitopes now well-described and classified for both the major class of CA125 antibodies of the OC125 group and the M11 group. More than 60 repeat units have been identified, sequenced, and contiguously placed in the CA125 domain structure. The repeat sequences demonstrated 70-85% homology to each other. The existence of the repeat sequences was confirmed by expression of the recombinant protein in *E. coli* where both OC125/M11 class antibodies were found to bind to sites on the CA125 repeat.

The CA125 molecule is anchored at its carboxy terminal through a transmembrane domain and a short cytoplasmic tail. The carboxy terminal also contains a proteolytic cleavage site approximately 50 amino acids upstream from the transmembrane domain, which allows for proteolytic cleavage and release of the CA125 molecule. The identification and sequencing of multiple repeat domains of the CA125 antigen provides potentially new clinical and therapeutic applications for detecting, monitoring and treating patients with ovarian cancer and other carcinomas where CA125 is expressed. For example, the ability to express repeat domains of CA125 with the appropriate epitopes would provide a much needed standard reagent for research and clinical applications. Current assays for CA125 utilize as standards either CA125 produced from cultured cell lines or from patient ascites fluid. Neither source is defined with regard to the quality or purity of the CA125 molecule. The present invention overcomes the disadvantages of current assays by providing multiple repeat domains of CA125 with epitope binding sites. At least one or more of any of the more than 60 repeats shown in Table 16 can be used as a "gold standard" for testing the presence of CA125. Furthermore, new and more specific assays may be developed utilizing recombinant products for antibody production.

Perhaps even more significantly, the multiple repeat domains of CA125 or other domains could also be used for the development of a potential vaccine for patients with ovarian cancer. In order to induce cellular and humoral immunity in humans to CA125, murine antibodies specific for CA125 were utilized in anticipation of patient production of anti-ideotypic antibodies, thus indirectly allowing the induction of an immune response to the CA125 molecule. With the availability of recombinant CA125, especially domains which encompass epitope binding sites for known murine antibodies, it will be feasible to more directly stimulate patients' immune systems to CA125 and, as a result, extend the life of ovarian carcinoma patients.

The recombinant CA125 of the present invention may also be used to develop therapeutic targets. Molecules like CA125, which are expressed on the surface of tumor cells, provide potential targets for immune stimulation, drug delivery, biological modifier delivery or any agent which can be specifically delivered to ultimately kill the tumor cells. Humanized or human antibodies to CA125 epitopes could be used to deliver all drug or toxic agents including radioactive agents to mediate direct killing of tumor cells. Natural ligands having a natural binding affinity for domains on the CA125 molecule could also be utilized to deliver therapeutic agents to tumor cells.

CA125 expression may further provide a survival or metastatic advantage to ovarian tumor cells. Antisense oligonucleotides derived from the CA125 repeat sequences could be used to down-regulate the expression of CA125. Further, antisense therapy could be used in association with a tumor cell delivery system of the type described above.

Recombinant domains of the CA125 molecule also have the potential to identify small molecules, which bind to individual domains of the CA125 molecule. These small molecules could also be used as delivery agents or as biological modifiers.

In one aspect of the present invention, a CA125 molecule is disclosed comprising: (a) an extracellular amino terminal domain, comprising 5 genomic exons, wherein exon 1 comprises amino acids #1-33 of SEQ ID NO: 299, exon 2 comprises amino acids #34-1593 of SEQ ID NO: 299, exon 3 comprises amino acids #1594-1605 of SEQ ID NO: 299, exon 4 comprises amino acids #1606-1617 of SEQ ID NO: 299, and exon 5 comprises amino acids #1618-1637 of SEQ ID NO: 299; (b) an amino terminal extension, comprising 4 genomic exons, wherein exon 1 comprises amino acids #1-3157 of SEQ ID NO: 310, exon 2 comprises amino acids #3158-3193 of SEQ ID NO: 310, exon 3 comprises amino acids #3194-9277 of SEQ ID NO: 310, and exon 4 comprises amino acids #9278-10,427 of SEQ ID NO: 310; (c) a multiple repeat domain, wherein each repeat unit comprises 5 genomic exons, wherein exon 1 comprises amino acids #1-42 in any of SEQ ID NOS: 164 through 194; exon 2 comprises amino acids #43-65 in any of SEQ ID NOS: 195 through 221; exon 3 comprises amino acids #66-123 in any of SEQ ID NOS: 222 through 249; exon 4 comprises amino acids #124-135 in any of SEQ ID NOS: 250 through 277; and exon 5 comprises amino acids #136-156 in any of SEQ ID NOS: 278 through 298; and (d) a carboxy terminal domain comprising a transmembrane anchor with a short cytoplasmic domain, and further comprising 9 genomic exons, wherein exon 1 comprises amino acids #1-11 of SEQ ID NO: 300; exon 2 comprises amino acids #12-33 of SEQ ID NO: 300; exon 3 comprises amino acids #34-82 of SEQ ID NO: 300; exon 4 comprises amino acids #83-133 of SEQ ID NO: 300; exon 5 comprises amino acids #134-156 of SEQ ID NO: 300; exon 6 comprises amino acids #157-212 of SEQ ID NO: 300; exon 7 comprises amino acids #213-225 of SEQ ID NO: 300; exon 8 comprises amino acids #226-253 of SEQ ID NO: 300; and exon 9 comprises amino acids #254-284 of SEQ ID NO: 300.

In another aspect of the invention, the repeats comprise amino acids selected from the group consisting of SEQ ID NO 11-46, 69-80 and 58-161, wherein the repeats in any of the repeats are in any order.

In another aspect of the present invention, the N-glycosylation sites of the amino terminal domain marked (x) in FIG. 8B are encoded at positions #81, #271, #320, #624, #795, #834, #938, and #1,165 in SEQ ID NO: 299.

In another aspect of the present invention, the serine and threonine O-glycosylation pattern for the amino terminal domain is marked (o) in SEQ ID NO: 299 in FIG. 8B.

In another aspect of the present invention, the N-glycosylation sites of the amino terminal extension marked (x) in Table 26 are encoded at positions #139, #434, #787, #930, #957, #1266, #1375, #1633, #1840, #1877, #1890, #2345, #2375, #2737, #3085, #3178, #3501, #4221, #4499, #4607, #4614, #4625, #5048, #5133, #5322, #5396, #5422, #5691, #5865, #6090, #6734, #6861, #6963, #8031, #8057, #8326, #8620, #8686, #8915, #9204, #9495, #9787, #10,077, and #10,175.

In another aspect, the serine and threonine O-glycosylation pattern for the amino terminal extension is marked (o) in Table 26.

In another aspect of the present invention, exon 1 in the repeat domain comprises at least 31 different copies; exon 2 comprises at least 27 different copies; exon 3 comprises at least 28 different copies; exon 4 comprises at least 28 different copies, and exon 5 comprises at least 21 different copies.

In another aspect of the present invention, the repeat domain comprises 156 amino acid repeat units which comprise epitope binding sites. The epitope binding sites are located in at least part of the C-enclosure at amino acids #59-79 (marked C-C) in SEQ ID NO: 150 in FIG. 5.

In another aspect, the 156 amino acid repeat unit comprises O-glycosylation sites at positions #128, #129, #132, #133, #134, #135, #139, #145, #146, #148, #150, #151, and #156 in SEQ ID NO: 150 in FIG. 5C. The 156 amino acid repeat unit further comprises N-glycosylation sites at positions #33 and #49 in SEQ ID NO: 150 in FIG. 5C. The repeat unit also includes at least one conserved methionine (designated M) at position #24 in SEQ ID NO: 150 in FIG. 5C.

In another aspect of the invention, the multiple repeat domain is made of repeats selected from SEQ ID NOS 11-46, 69-80 and 58-161, wherein the repeat units are in any order.

In yet another aspect, the transmembrane domain of the carboxy terminal domain is located at positions #230-252 (underlined) in SEQ ID NO: 300 of FIG. 9B. The cytoplasmic domain of the carboxy terminal domain comprises a highly basic sequence adjacent to the transmembrane at positions #256-260 in SEQ ID NO: 300 of FIG. 9B, serine and threonine phosphorylation sites at positions #254, #255, and #276 in SEQ ID NO: 300 in FIG. 9B, and tyrosine phosphorylation sites at positions #264, #273, and #274 in SEQ ID NO: 300 of FIG. 9B.

In another aspect of the present invention, an isolated nucleic acid of the CA125 gene is disclosed, which comprises a nucleotide sequence selected from the group consisting of: (a) the nucleotide sequences set forth in SEQ ID NOS: 311, 312, 313 and 314; (b) a nucleotide sequence having at least 70% sequence identity to any one of the sequences in (a); (c) a degenerate variant of any one of (a) to (b); and (d) a fragment of any one of (a) to (c).

In another aspect of the present invention, an isolated nucleic acid of the CA125 gene, comprising a sequence that encodes a polypeptide with the amino acid sequence selected from the group consisting of: (a) the amino acid sequences set forth in SEQ ID NO: 315; (b) an amino acid sequence having at least 50% sequence identity to any one of the sequences in (a); (c) a conservative variant of any one of (a) to (b); and (d) a fragment of any one of (a) to (c).

In yet another aspect, a vector comprising the nucleic acid of the CA125 gene is disclosed. The vector may be a cloning vector, a shuttle vector, or an expression vector. A cultured cell comprising the vector is also disclosed.

In yet another aspect, a method of expressing CA125 antigen in a cell is disclosed, comprising the steps of: (a) providing at least one nucleic acid comprising a nucleotide sequence selected from the group consisting of: (i) the nucleotide sequences set forth in SEQ ID NOS: 49, 67, 81, 83-145, 147, 150, and 152; (ii) a nucleotide sequence having at least 70% sequence identity to any one of the sequences in (i); (iii) a degenerate variant of any one of (i) to (ii); and (iv) a fragment of any one of (i) to (iii); (b) providing cells comprising an mRNA encoding the CA125 antigen; and (c) introducing the nucleic acid into the cells, wherein the CA125 antigen is expressed in the cells.

In yet another aspect, a purified polypeptide of the CA125 gene, comprising an amino acid sequence selected from the group consisting of: (a) the amino acid sequences set forth in SEQ ID NOS: 11-48, 50, 68-80, 82, 146, 148, 149, 150, 151, and 153-158; (b) an amino acid sequence having at least 50% sequence identity to any one of the sequences in (a); (c) a conservative variant of any one of (a) to (b); and (d) a fragment of any one of (a) to (c).

In another aspect, a purified antibody that selectively binds to an epitope in the receptor-binding domain of CA125 protein, wherein the epitope is within the amino acid sequence selected from the group consisting of: (a) the amino acid sequences set forth in SEQ ID NOS: 11-48, 50, 68-80, 146, 151, and 153-158; (b) an amino acid sequence having at least 50% sequence identity to any one of the sequences in (a); (c) a conservative variant of any one of (a) to (b); and (d) a fragment of any one of (a) to (c).

More specifically, this invention relates to a purified antibody that selectively binds to an epitope in the CA125 protein of SEQ ID NO 315. Similarly, the purified antibody selectively binds to an amino acid sequence having at least 50% sequence identity to said sequence; the purified antibody selectively binds to an amino acid sequence having at least 60% sequence identity to said sequence; the purified antibody selectively binds to an amino acid sequence having at least 70% sequence identity to said sequence; the purified antibody selectively binds to an amino acid sequence having at least 80% sequence identity to said sequence; and the purified antibody selectively binds to an amino acid sequence having at least 90% sequence identity to said sequence. Additionally, purified antibody can be a conservative variant of the amino acid sequence set forth in SEQ ID NO 315 or a fragment thereof.

A diagnostic for detecting and monitoring the presence of CA125 antigen is also disclosed, which comprises recombinant CA125 comprising at least one repeat unit of the CA125 repeat domain including epitope binding sites selected from the group consisting of amino acid sequences set forth in SEQ ID NOS: 11-48, 50, 68-80, 82, 146, 150, 151, 153-161, and 162 (amino acids #1,643-11,438).

A therapeutic vaccine to treat mammals with elevated CA125 antigen levels or at risk of developing a disease or disease recurrence associated with elevated CA125 antigen levels is also disclosed. The vaccine comprises recombinant CA125 repeat domains including epitope binding sites, wherein the repeat domains are selected from the group of amino acid sequences consisting of SEQ ID NOS: 11-48, 50, 68-80, 82, 146, 148, 149, 150, 151, 153-161, and 162 (amino acids #1,643-11,438), and amino acids #175-284 of SEQ ID NO: 300. Mammals include animals and humans.

In another aspect of the present invention, an antisense oligonucleotide is disclosed that inhibits the expression of CA 125 encoded by: (a) the nucleotide sequences set forth in SEQ ID NOS: 49, 67, 81, 83-145, 147, 150, and 152; (b) a nucleotide sequence having at least 70% sequence identity to any one of the sequences in (a); (c) a degenerate variant of any one of (a) to (b); and (d) a fragment of any one of (a) to (c).

The preceding and further aspects of the present invention will be apparent to those of ordinary skill in the art from the following description of the presently preferred embodiments of the invention, such description being merely illustrative of the present invention.

BRIEF DESCRIPTION OF THE DRAWINGS

FIG. 2A illustrates PCR amplification of products generated from primers utilizing the EST sequence referred to in FIG. 1, the amino acid sequence obtained from the 40 kDa fragment and EST sequence AA#640762. Lane 1-2: normal; 3: serous ovarian carcinoma; 4: serous ovarian carcinoma; 5: mucinous ovarian carcinoma; 6: β-tubulin control. The anticipated size band 400 b is present in lane 3 and less abundantly in lane 4.

FIG. 2B illustrates the RT-PCR that was performed to determine the presence or absence of CA125 transcripts in primary culture cells of ovarian tumors. This expression was compared to tubulin expression as an internal control. Lanes 1, 3, 5, 7, and 9 represent the primary ovarian tumor cell lines. Lanes 2, 4, 6, and 8 represent peripheral blood mononuclear cell lines derived from the corresponding patients in lanes 1, 3, 5, and 7. Lane 10 represents fibroblasts from the patient tumor in lane 9. Lanes 11 and 12 are CaOV3 and a primary tumor specimen, respectively.

FIG. 7B represents the genomic structure and exon configuration of a 156 amino acid repeat sequence of CA125 (SEQ ID NO: 163), which comprises a standard repeat unit.

FIGS. 7C, D, E and F list the individual known sequences for each exon, which have been determined as follows: Exon 1—SEQ ID NOS: 164-194; Exon 2—SEQ ID NOS: 195-221; Exon 3—SEQ ID NOS: 222-249; Exon 4—SEQ ID NOS: 250-277; and Exon 5—SEQ ID NOS: 278-298.

FIG. 8B illustrates the amino acid composition of the amino terminal domain (SEQ ID NO: 299) with each potential O-glycosylation site marked with a superscript (o) and N-glycosylation sites marked with a superscript (x). T-TALK sequences are underlined.

FIG. 9B illustrates the amino acid composition of the carboxy terminal domain (SEQ ID NO: 300) including the exon boundaries, O-glycosylation sites (O), and N-glycosylation sites (x). The proposed transmembrane domain is underlined.

DETAILED DESCRIPTION OF THE INVENTION

Figure 1:
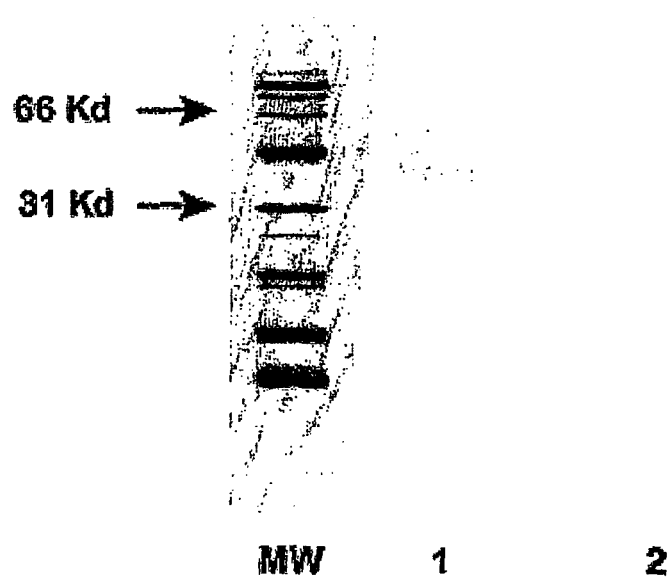
FIG. 1 illustrates the cyanogen bromide digested products of CA125 on Western blot probed with M11 and OC125 antibodies. Table 1 shows the amino acid sequence derived from the amino terminal end of the 40 kDa cyanogen bromide peptide along with internal sequences obtained after protease digestion of the 40 kDa fragment (SEQ ID NOS: 1-4). SEQ ID NO: 1 is the amino terminal sequence derived of the 40 kDa peptide and SEQ ID NOS: 2, 3, and 4 reflect internal amino acid sequences derived from peptides after protease digestion of the 40 kDa fragment. Table 1 further provides a translation of the EST (BE005912) with homologous sequences (SEQ ID NOS: 5 and 6) either boxed or underlined. Protease cleavage sites are indicated by arrows.

In accordance with the present invention, conventional molecular biology, microbiology, and recombinant DNA techniques may be used that will be apparent to those skilled in the relevant art. Such techniques are explained fully in the literature (see, e.g., Maniatis, Fritsch & Sambrook, "Molecular Cloning: A Laboratory Manual (1982); "DNA Cloning: A Practical Approach," Volumes I and II (D. N. Glover ed. 1985); "Oligonucleotide Synthesis" (M. J. Gait ed. 1984); "Nucleic Acid Hybridization" (B. D. Hames & S. J. Higgins eds. (1985)); "Transcription and Translation" (B. D. Hames & S. J. Higgins eds. (1984)); "Animal Cell Culture" (R. I. Freshney, ed. (1986)); "Immobilized Cells And Enzymes" (IRL Press, (1986)); and B. Perbal, "A Practical Guide To Molecular Cloning" (1984)).

Therefore, if appearing herein, the following terms shall have the definitions set out below.

A "vector" is a replicon, such as plasmid, phage or cosmid, to which another DNA segment may be attached so as to bring about the replication of the attached segment.

A "DNA molecule" refers to the polymeric form of deoxyribonucleotides (adenine, guanine, thymine, or cytosine) in either single stranded form, or a double-stranded helix. This term refers only to the primary and secondary structure of the molecule, and does not limit it to any particular tertiary forms. Thus, this term includes double-stranded DNA found, inter alia, in linear DNA molecules (e.g., restriction fragments), viruses, plasmids, and chromosomes.

As used herein, the term "gene" shall mean a region of DNA encoding a polypeptide chain.

"Messenger RNA" or "mRNA" shall mean an RNA molecule that encodes for one or more polypeptides.

"DNA polymerase" shall mean an enzyme which catalyzes the polymerization of deoxyribonucleotide triphosphates to make DNA chains using a DNA template.

"Reverse transcriptase" shall mean an enzyme which catalyzes the polymerization of deoxy- or ribonucleotide triphosphates to make DNA or RNA chains using an RNA or DNA template.

"Complementary DNA" or "cDNA" shall mean the DNA molecule synthesized by polymerization of deoxyribonucleotides by an enzyme with reverse transcriptase activity.

An "isolated nucleic acid" is a nucleic acid the structure of which is not identical to that of any naturally occurring nucleic acid or to that of any fragment of a naturally occurring genomic nucleic acid spanning more than three separate genes. The term therefore covers, for example, (a) a DNA which has the sequence of part of a naturally occurring genomic DNA molecule but is not flanked by both of the coding sequences that flank that part of the molecule in the genome of the organism in which it naturally occurs; (b) a nucleic acid incorporated into a vector or into the genomic DNA of a prokaryote or eukaryote in a manner such that the resulting molecule is not identical to any naturally occurring vector or genomic DNA; (c) a separate molecule such as a cDNA, a genomic fragment, a fragment produced by polymerase chain reaction (PCR), or a restriction fragment; and (d) a recombinant nucleotide sequence that is part of a hybrid gene, i.e., a gene encoding a fusion protein.

"Oligonucleotide", as used herein in referring to the probes or primers of the present invention, is defined as a molecule comprised of two or more deoxy- or ribonucleotides, preferably more than ten. Its exact size will depend upon many factors which, in turn, depend upon the ultimate function and use of the oligonucleotide.

"DNA fragment" includes polynucleotides and/or oligonucleotides and refers to a plurality of joined nucleotide units formed from naturally-occurring bases and cyclofuranosyl groups joined by native phosphodiester bonds. This term effectively refers to naturally-occurring species or synthetic species formed from naturally-occurring subunits. "DNA fragment" also refers to purine and pyrimidine groups and moieties which function similarly but which have non naturally-occurring portions. Thus, DNA fragments may have altered sugar moieties or inter-sugar linkages. Exemplary among these are the phosphorothioate and other sulfur containing species. They may also contain altered base units or other modifications, provided that biological activity is retained. DNA fragments may also include species which include at least some modified base forms. Thus, purines and pyrimidines other than those normally found in nature may be so employed. Similarly, modifications on the cyclofuranose portions of the nucleotide subunits may also occur as long as biological function is not eliminated by such modifications.

"Primer" shall refer to an oligonucleotide, whether occurring naturally or produced synthetically, which is capable of acting as a point of initiation of synthesis when placed under conditions in which synthesis of a primer extension product, which is complementary to a nucleic acid strand, is induced, i.e., in the presence of nucleotides and an inducing agent such as a DNA polymerase and at a suitable temperature and pH. The primer may be either single-stranded or double-stranded and must be sufficiently long to prime the synthesis of the desired extension product in the presence of the inducing agent. The exact length of the primer will depend upon many factors, including temperature, the source of primer and the method used. For example, for diagnostic applications, depending on the complexity of the target sequence, the oligonucleotide primer typically contains 10-25 or more nucleotides, although it may contain fewer nucleotides.

The primers herein are selected to be "substantially" complementary to different strands of a particular target DNA sequence. This means that the primers must be sufficiently complementary to hybridize with their respective strands. Therefore, the primer sequence need not reflect the exact sequence of the template. For example, a non-complementary nucleotide fragment may be attached to the 5' end of the primer, with the remainder of the primer sequence being complementary to the strand. Alternatively, non-complementary bases or longer sequences can be interspersed into the primer, provided that the primer sequence has sufficient complementarity with the sequence or hybridize therewith and thereby form the template for the synthesis of the extension product.

As used herein, the term "hybridization" refers generally to a technique wherein denatured RNA or DNA is combined with complementary nucleic acid sequence which is either free in solution or bound to a solid phase. As recognized by one skilled in the art, complete complementarity between the two nucleic acid sequences is not a pre-requisite for hybridization to occur. The technique is ubiquitous in molecular genetics and its use centers around the identification of particular DNA or RNA sequences within complex mixtures of nucleic acids.

As used herein, "restriction endonucleases" and "restriction enzymes" shall refer to bacterial enzymes which cut double-stranded DNA at or near a specific nucleotide sequence.

"Purified polypeptide" refers to any peptide generated from CA125 either by proteolytic cleavage or chemical cleavage.

"Degenerate variant" refers to any amino acid variation in the repeat sequence, which fulfills the homology exon structure and conserved sequences and is recognized by the M11, OC125 and ISOBM series of antibodies.

"Fragment" refers to any part of the CA125 molecule identified in a purification scheme.

"Conservative variant antibody" shall mean any antibody that fulfills the criteria of M11, OC125 or any of the ISOBM antibody series.

The CA125 gene has been cloned and multiple repeat sequences as well as the carboxy terminus have been identified. The genomic DNA for the CA125 gene is set out in SEQ ID NO 311-313. The CA125 molecule comprises three major domains: an extracellular amino terminal domain (Domain 1); a large multiple repeat domain (Domain 2); and a carboxy terminal domain (Domain 3) which includes a transmembrane anchor with a short cytoplasmic domain. The amino terminal domain is assembled by combining five genomic exons, four very short amino terminal sequences and one extraordinarily large exon. This domain is dominated by its capacity for O-glycosylation and its resultant richness in serine and threonine residues. Additionally, an amino terminal extension is present, which comprises four genomic exons. The amino acid composition of the amino terminal extension was found to be consistent with the amino acid composition of the amino terminal domain. The molecular structure is dominated by a repeat domain comprising 156 amino acid repeat units, which encompass the epitope binding sites. More than 60 repeat units have been identified, sequenced, and contiguously placed in the CA125 domain structure. The repeat units encompass an interactive disulfide bridged C-enclosure and the site of OC125 and M11 binding. The repeat sequences demonstrated 70-85% homology to each other. Expression of the repeats was demonstrated in $E.\ coli$. The CA125 molecule is anchored at its carboxy terminal through a transmembrane domain and a short cytoplasmic tail. The carboxy terminal also contains a proteolytic cleavage site approximately 50 amino acids upstream from the transmembrane domain, which allows for proteolytic cleavage and release of the CA125 molecule. Any one of the repeat domains has the potential for use as a new gold standard for detecting and monitoring the presence of the CA125 antigen. Further, the repeat domains or other domains, especially the c-terminal to the repeat domain also provide a basis for the development of a vaccine, which would be useful for the treatment of ovarian cancer and other carcinomas where CA125 is elevated.

The DNA sequences of the present invention can also be characterized as encoding the amino acid sequence equivalents of the amino acid sequence, equivalents, as used in this context, include peptides of substantially similar length and amino acid identity to those disclosed, but having conservative amino acid substitution at a non-critical residue position. A conservative amino acid substitution is a substitution in which an amino acid residue is replaced with an amino acid residue of differing identity, but whose R group can be characterized by chemically similar. Four common categories include: polor but uncharged R groups; positively charged R groups; negatively charged R groups; and, hydrophobic R groups. A preferred conservative substitution involves the substitution of a second hydrophobic residue for a fir hydrophobic residue, the first and second hydrophobic residues differing primarily in the size of the R group. The hydrophobic residue would be predicted to be located internally in the folded peptide structure and the mild pertubatim caused only by a change in the size of an R group at an internally located which would not alter the antigenicity of R protein.

The isolated cDNA sequences (Table 30 and SEQ ID NO 314) of the present invention can be inserted into an expression vector. Such vectors contain all necessary regulatory signals to promote the expression of a DNA sequence of interest. Expression vectors are typically either prokaryote or eukaryote specific. Expression vectors can be introduced into either prokaryote or eukaryote cells to produce CA125 proteins or portions thereof. This cDNA sequence was expressed to provide the CA125 molecule set out in Table 31 and SEQ ID NO 315.

Materials and Methods

A. Tissue Collection, RNA Isolation and cDNA Synthesis

Both normal and ovarian tumor tissues were utilized for cDNA preparation. Tissues were routinely collected and stored at −80° C. according to a tissue collection protocol.

Total RNA isolation was performed according to the manufacturer's instructions using the TriZol Reagent purchased from GibcoBRL (Catalog #15596-018). In some instances, mRNA was isolated using oligo dT affinity chromatography. The amount of RNA recovered was quantitated by UV spectrophotometry. First strand complementary DNA (cDNA) was synthesized using 5.0 μg of RNA and random hexamer primers according to the manufacturer's protocol utilizing a first strand synthesis kit obtained from Clontech (Catalog #K1402-1). The purity of the cDNA was evaluated by PCR using primers specific for the β-tubulin gene. These primers span an intron such that the PCR products generated from pure cDNA can be distinguished from cDNA contaminated with genomic DNA.

B. Identification and Ordering of CA125 Repeat Units

It has been demonstrated that the 2-5 million dalton CA125 glycoprotein (with repeat domains) can be chemically segmented into glycopeptide fragments using cyanogen bromide. As shown in FIG. 1, several of these fragments, in particular the 40 kDa and 60 kDa fragments, still bind to the to the two classical antibody groups defined by OC 125 and M11.

To convert CA125 into a consistent glycopeptide, the CA125 parent molecule was processed by cyanogen bromide digestion. This cleavage process resulted in two main fractions on commassie blue staining following polyacrylamide gel electrophoresis. An approximately 60 kDa band and a more dominant 40 kDa band were identified as shown in FIG. 1. When a Western blot of these bands was probed with either OC125 or M11 antibodies (both of which define the CA125 molecule), these bands bound both antibodies. The 40 kDa band was significantly more prominent than the 60 kDa band. These data thus established the likelihood of these bands (most especially the 40 kDa band) as being an authentic cleavage peptide of the CA125 molecule, which retained the identifying characteristic of OC125 and M11 binding.

The 40 kDa and 60 kDa bands were excised from PVDF blots and submitted to amino terminal and internal peptide amino acid sequencing as described and practiced by Harvard Sequencing, (Harvard Microchemistry Facility and The Biological Laboratories, 16 Divinity Avenue, Cambridge, Mass. 02138). Sequencing was successful only for the 40 kDa band where both amino terminal sequences and some internal sequences were obtained as shown in Table 1 at SEQ ID NOS: 1-4. The 40 kDa fragment of the CA125 protein was found to have homology to two translated EST sequences (GenBank Accession Nos. BE005912 and AA640762). Visual examination of these translated sequences revealed similar amino acid regions, indicating a possible repetitive domain. The nucleotide and amino acid sequences for EST Genbank Accession No. BE005912 (corresponding to SEQ ID NO: 5 and SEQ ID NO: 6, respectively) are illustrated in Table 1. Common sequences are boxed or underlined.

In an attempt to identify other individual members of this proposed repeat family, two oligonucleotide primers were synthesized based upon regions of homology in these EST sequences. Shown in Table 2A, the primer sequences correspond to SEQ ID NOS: 7 and 8 (sense primers) and SEQ ID NOS: 9 and 10 (antisense primers). Repeat sequences were amplified in accordance with the methods disclosed in the following references: Shigemasa K et al., p21: A monitor of p53 dysfunction in ovarian neoplasia, *Int. J. Gynecol. Cancer* 7:296-303 (1997) and Shigemasa K et al., p16 Overexpression: A potential early indicator of transformation in ovarian carcinoma, *J. Soc. Gynecol. Invest.* 4:95-102 (1997). Ovarian tumor cDNA obtained from a tumor cDNA bank was used.

Amplification was accomplished in a Thermal Cycler (Perkin-Elmer Cetus). The reaction mixture consisted of 1 U Taq DNA Polymerase in storage buffer A (Promega), 1× Thermophilic DNA Polymerase 10×Mg free buffer (Promega), 300 mM dNTPs, 2.5 mM MgCl2, and 0.25 mM each of the sense and antisense primers for the target gene. A 20 µl reaction included 1 µl of cDNA synthesized from 50 ng of mRNA from serous tumor mRNA as the template. PCR reactions required an initial denaturation step at 94° C./1.5 min. followed by 35 cycles of 94° C./0.5 min., 48° C./0.5 min., 72° C./0.5 min. with a final extension at 72° C./7 min. Three bands were initially identified (>>400 bp, >>800 bp, and >>1200 bp) and isolated. After size analysis by agarose gel electrophoresis, these bands as well as any other products of interest were then ligated into a T-vector plasmid (Promega) and transformed into competent DH5a strain of *E. coli* cells. After growth on selective media, individual colonies were cultured overnight at 37° C., and plasmid DNA was extracted using the QIAprep Spin Miniprep kit (Qiagen). Positive clones were identified by restriction digests using Apa I and Sac I. Inserts were sequenced using an ABI automatic sequencer, Model 377, T7 primers, and a Big Dye Terminator Cycle Sequencing Kit (Applied Biosystems).

Obtained sequences were analyzed using the Pileup program of the Wisconsin Genetic's Computer Group (GCG). Repeat units were ordered using primers designed against two highly conserved regions within the nucleotide sequence of these identified repeat units. Shown in Table 2B, the sense and antisense primers (5'-GTCTCTATGTCAATG-GTTTCACCC-3'/5'-TAGCTGCTCTCTGTCCAGTCC-3' SEQ ID NOS: 301 and 302, respectively) faced away from one another within any one repeat creating an overlap sequence, thus enabling amplification across the junction of any two repeat units. PCR reactions, cloning, sequencing, and analysis were performed as described above.

C. Identification and Assembly of the CA125 Amino Terminal Domain

In search of open reading frames containing sequences in addition to CA125 repeat units, database searches were performed using the BLAST program available at the National Center for Biotechnology Information (www.ncbi.nlm.nih.gov/). Using a repeat unit as the query sequence, cosmid AC008734 was identified as having multiple repeat sequences throughout the unordered (35) contiguous pieces of DNA, also known as contigs. One of these contigs, #32, was found to have exons 1 and 2 of a repeat region at its 3' end. Contig#32 was also found to contain a large open reading frame (ORF) upstream of the repeat sequence. PCR was again used to verify the existence of this ORF and confirm its connection to the repeat sequence. The specific primers recognized the 3' end of this ORF (5'-CAGCAGAGACCAG-CACGAGTACTC-3') (SEQ ID NO: 51) and sequence within the repeat (5'-TCCACTGCCATGGCTGAGCT-3') (SEQ ID NO: 52). The remainder of the amino-terminal domain was assembled from this contig in a similar manner. With each PCR confirmation, a new primer (see Table 10A) was designed against the assembled sequence and used in combination with a primer designed against another upstream potential ORF (Set 1: 5'-CCAGCACAGCTCTTCCCAG-GAC-3'/5'-GGAATGGCTGAGCTGACGTCTG-3'(SEQ ID NO: 53 and SEQ ID NO: 54); Set 2: 5'-CTTCCCAGGA-CAACCTCAAGG-3'/5'-GCAGGATGAGTGAGC-CACGTG-3'(SEQ ID NO: 55 and SEQ ID NO: 56); Set 3: 5'-GTCAGATCTGGTGACCTCACTG-3'/5'-GAG-GCACTGGAAAGCCCAGAG-3') (SEQ ID NO: 57 and SEQ ID NO: 58). Potential adjoining sequence (contig #7 containing EST AU133673) was also identified using contig #32 sequence as query sequence in database searches. Confirmation primers were designed and used in a typical manner (5'-CTGATGGCATTATGGAACACATCAC-3'/5'-CCCA-GAACGAGAGACCAGTGAG-3') (SEQ ID NO: 59 and SEQ ID NO: 60).

In order to identify the 5' end of the CA125 sequence, 5' Rapid Amplification of cDNA Ends (FirstChoice™ RLM-RACE Kit, Ambion) was performed using tumor cDNA. The primary PCR reaction used a sense primer supplied by Ambion (5'-GCTGATGGCGATGAATGAACACTG-3') (SEQ ID NO: 61) and an anti-sense primer specific to confirmed contig #32 sequence (5'-CCCAGAACGAGAGAC-CAGTGAG-3') (SEQ ID NO: 62). The secondary PCR was then performed using nested primers, sense from Ambion (5'-CGCGGATCCGAACACTGCGTTTGCTG-GCTTTGATG-3') (SEQ ID NO: 63) and the anti-sense was specific to confirmed contig #7 sequence (5'-CCTCTGTGT-GCTGCTTCATTGGG-3') (SEQ ID NO: 64). The RACE PCR product (a band of approximately 300 bp) was cloned and sequenced as previously described.

D. Identification and Assembly of the CA125 Carboxy Terminal Domain

Database searches using confirmed repeat units as query also identified a cDNA sequence (GenBank AK024365) containing other repeat units, but also a potential carboxy terminal sequence. The contiguous nature of this sequence with assembled CA125 was confirmed using PCR (5'-GGACAAGGTCACCACACTCTAC-3'/5'-GCAGATCCTCCAGGTCTAGGTGTG-3'), (SEQ ID NO: 303 and SEQ ID NO: 304, respectively) as well as contig and EST analysis.

E. Expression of 6×His-Tagged CA125 Repeat in *E. coli*

The open reading frame of a CA125 repeat shown in Table 11 was amplified by PCR with the sense primer (5'-ACCGGATCCATGGGCCACACAGAGCCTGGCCC-3') (SEQ ID NO: 65) the antisense primer (5'-TGTAAGCTTAGGCAGGGAGGATGGAGTCC-3') (SEQ ID NO: 66) PCR was performed in a reaction mixture consisting of ovarian tumor cDNA derived from 50 ng of mRNA, 5 pmol each of sense and antisense primers for the CA125 repeat, 0.2 mmol of dNTPs, and 0.625 U of Taq polymerase in 1× buffer in a final volume of 25 ml. This mixture was subjected to 1 minute of denaturation at 95° C. followed by 30 cycles of PCR consisting of the following: denaturation for 30 seconds at 95° C., 30 seconds of annealing at 62° C., and 1 minute of extension at 72° C. with an additional 7 minutes of extension on the last cycle. The product was electrophoresed through a 2% agarose gel for separation. The PCR product was purified and digested with the restriction enzymes Bam HI and Hind III. This digested PCR product was then ligated into the expression vector pQE-30, which had also been digested with Bam HI and Hind III. This clone would allow for expression of recombinant 6×His-tagged CA125 repeat. Transformed *E. coli* (JM109) were grown to an OD600 of 1.5-2.0 at 37° C. and then induced with IPTG (0.1 mM) for 4-6 hours at 25° C. to produce recombinant protein. Whole *E. coli* lysate was electrophoresed through a 12% SDS polyacrylamide gel and Coomassie stained to detect highly expressed proteins.

F. Western Blot Analysis

Proteins were separated on a 12% SDS-PAGE gel and electroblotted at 100V for 40 minutes at 4° C. to nitrocellulose membrane. Blots were blocked overnight in phosphate-buffered saline (PBS) pH 7.3 containing 5% non-fat milk. CA125 antibodies M11, OC125, or ISOBM 9.2 were incubated with the membrane at a dilution of 5 µg/ml in 5% milk/PBS-T (PBS plus 0.1% TX-100) and incubated for 2 hours at room temperature. The blot was washed for 30 minutes with several changes of PBS and incubated with a 1:10,000 dilution of horseradish peroxidase (HRP) conjugated goat anti-mouse IgG antibody (Bio-Rad) for 1 hour at room temperature. Blots were washed for 30 minutes with several changes of PBS and incubated with a chemiluminescent substrate (ECL from Amersham Pharmacia Biotech) before a 10-second exposure to X-ray film for visualization.

Figure 4:
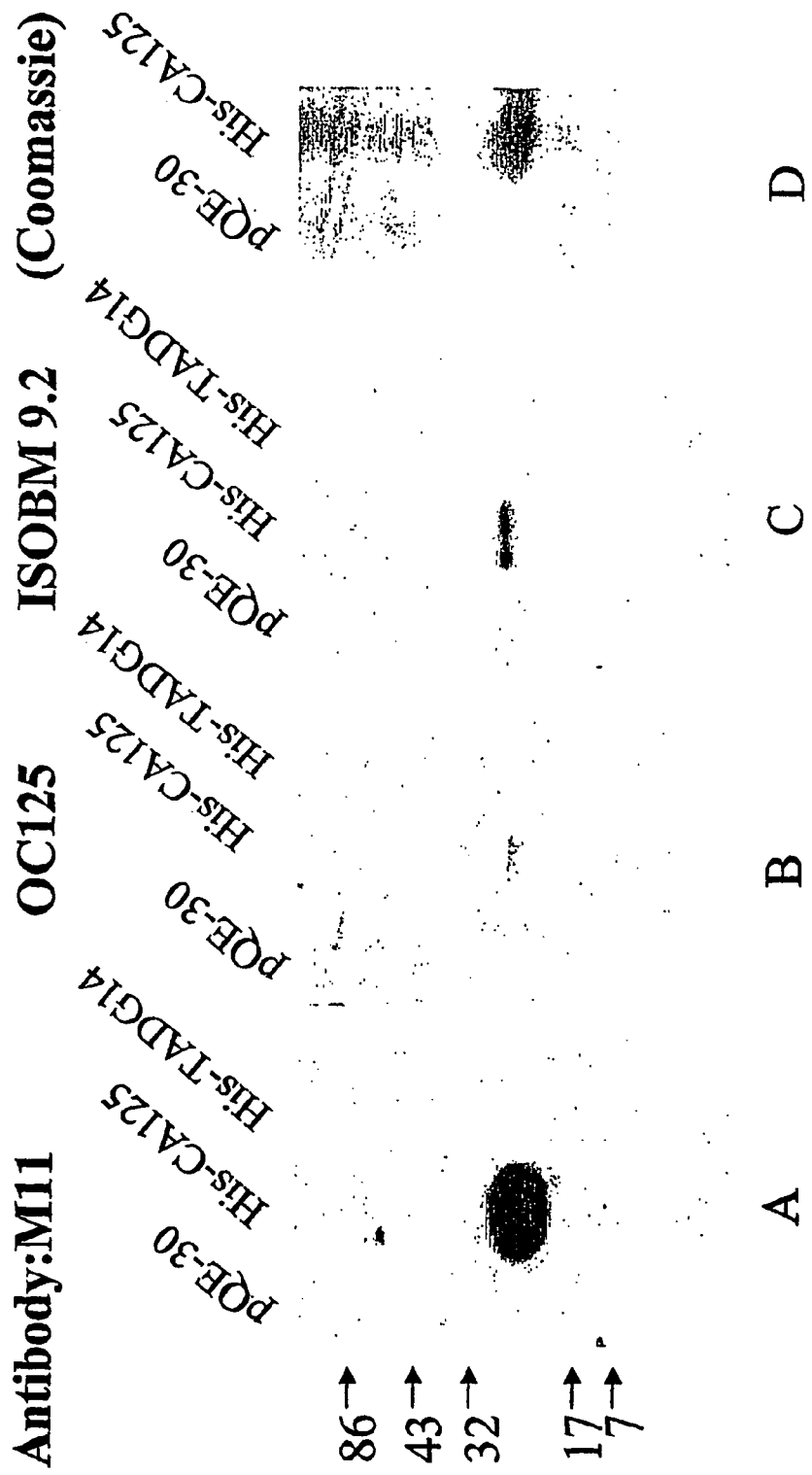
FIG. 4 illustrates three Western immunoblot patterns: Panel A=probed with M11, Panel B=probed with OC125 and Panel C=probed with antibody ISOBM 9.2. Each panel represents E. coli extracts as follows: lane 1=E. coli extract from bacteria with the plasmid PQE-30 only. Lane 2=E. coli extract from bacteria with the plasmid PQE-30 which includes the CA125 repeat unit. Lane 3=E. coli extract from bacteria with the plasmid PQE-30 which includes the TADG-14 protease unrelated to CA125. Panel D shows a Coomassie blue stain of a PAGE gel of E. coli extract derived from either PQE-30 alone or from bacteria infected with PQE-30-CA125 repeat (recombinant CA125 repeat).

FIG. 4 illustrates three Western immunoblot patterns of the recombinant CA125 repeat purified from *E. coli* lysate (lane 2) compared to *E. coli* lysate with no recombinant protein (lane 1-negative control) and a recombinant protein TADG-14 which is unrelated to CA125 (lane 3). As shown, the M11 antibody, the OC125 antibody and the antibody ISOBM 9.2 (an OC125-like antibody) all recognized the CA125 recombinant repeat (lane 2), but did not recognize either the *E. coli* lysate (lane 1) or the unrelated TADG-14 recombinant (lane 3). These data confirm that the recombinant repeat encodes both independent epitopes for CA125, the OC125 epitope and the M11 epitope.

G. Northern Blot Analysis

Total RNA samples (approximately 10 µg) were separated by electrophoresis through a 6.3% formaldehyde, 1.2% agarose gel in 0.02 M MOPS, 0.05 M sodium acetate (pH 7.0), and 0.001 M EDTA. The RNAs were then blotted to Hybond-N (Amersham) by capillary action in 20×SSPE and fixed to the membrane by baking for 2 hours at 80° C. A PCR product representing one 400 bp repeat of the CA125 molecule was radiolabelled using the Prime-a-Gene Labeling System available from Promega (cat. #U1100). The blot was probed and stripped according to the ExpressHyb Hybridization Solution protocol available from Clontech (Catalog #8015-1).

Results

In 1997, a system was described by a co-inventor of the present invention and others for purification of CA125 (primarily from patient ascites fluid), which when followed by cyanogen bromide digestion, resulted in peptide fragments of CA125 of 60 kDa and 40 kDa [O'Brien T J et al., More than 15 years of CA125: What is known about the antigen, its structure and its function, *Int J Biological Markers* 13(4)188-195 (1998)]. Both fragments were identifiable by commassie blue staining on polyacrylamide gels and by Western blot. Both fragments were shown to bind both OC125 and M11 antibodies, indicating both major classes of epitopes were preserved in the released peptides (FIG. 1).

Protein sequencing of the 40 kDa band yielded both amino terminal sequences and some internal sequences generated by protease digestion (Table 1—SEQ ID NOS: 1-4). Insufficient yields of the 60 kDa band resulted in unreliable sequence information. Unfortunately, efforts to amplify PCR products utilizing redundant primers designed to these sequences were not successful. In mid 2000, an EST (#BE005912) was entered into the GCG database, which contained homology to the 40 kDa band sequence as shown in Table 1 (SEQ ID NOS: 5 and 6). The translation of this EST indicated good homology to the amino terminal sequence of the 40 kDa repeat (e.g. residues 2-12 of SEQ ID NO:6) with only one amino acid difference (i.e. an asparagine is present instead of phenylalanine in the EST sequence). Also, some of the internal sequences are partially conserved (e.g. SEQ ID NO: 2 and to a lesser extent, SEQ ID NO: 3 and SEQ ID NO: 4). More importantly, all the internal sequences are preceded by a basic amino acid (Table 1, indicated by arrows) appropriate for proteolysis by the trypsin used to create the internal peptides from the 40 kDa cyanogen bromide repeat. Utilizing the combined sequences, those obtained by amino acid sequencing and those identified in the EST (#BE005912) and a second EST (#AA640762) identified in the database, sense primers were created as follows: 5'-GGA GAG GGT TCT GCA GGG TC-3' (SEQ ID NO: 7) representing amino acids ERVLQG (SEQ ID NO: 8) and anti-sense primer, 5' GTG AAT GGT ATC AGG AGA GG-3' (SEQ ID NO: 9) representing PLLIPF (SEQ ID NO: 10). Using PCR, the presence of transcripts was confirmed representing these sequences in ovarian tumors and their absence in normal ovary and either very low levels or no detectable levels in a mucinous tumor (FIG. 2A). The existence of transcripts was further confirmed in cDNA derived from multiple primary ovarian carcinoma cell lines and the absence of transcripts in matched lymphocyte cultures from the same patient (FIG. 2B).

After cloning and sequencing of the amplified 400 base pair PCR products, a series of sequences were identified, which had high homology to each other but which were clearly distinct repeat entities (FIG. 3) (SEQ ID NOS: 158 through 161).

Examples of each category of repeats were sequenced, and the results are shown in Tables 3, 4, and 5. The sequences represent amplification and sequence data of PCR products obtained using oligonucleotide primers derived from an EST (Genbank Accession No. BE005912). Table 3 illustrates the amino acid sequence for a 400 bp repeat in the CA125 molecule, which is identified as SEQ ID NO: 11 through SEQ ID NO: 21. Table 4 illustrates the amino acid sequence for a 800 bp repeat in the CA125 molecule, which corresponds to SEQ ID NO: 22 through SEQ ID NO: 35. Table 5 illustrates the amino acid sequence for a 1200 bp repeat in the CA125 molecule, which is identified as SEQ ID NO: 36 through SEQ ID NO: 46. Assembly of these repeat sequences (which showed 75-80% homology to each other as determined by GCG Software (GCG=Genetics Computer Group) using the Pileup application) utilizing PCR amplification and sequencing of overlapping sequences allowed for the construction of a 9 repeat structure. The amino acid sequence for the 9 repeat is shown in Table 6 as SEQ ID NO: 47. The individual C-enclosures are highlighted in the table.

Using the assembled repeat sequence in Table 6 to search genebank databases, a cDNA sequence referred to as Genbank Accession No. AK024365 (entered on Sep. 29, 2000) was discovered. Table 7 shows the amino acid sequence for AK024365, which corresponds to SEQ ID NO: 48. AK024365 was found to overlap with two repeats of the assembled repeat sequence shown in Table 6. Individual C-enclosures are highlighted in Table 7.

Figure 6:
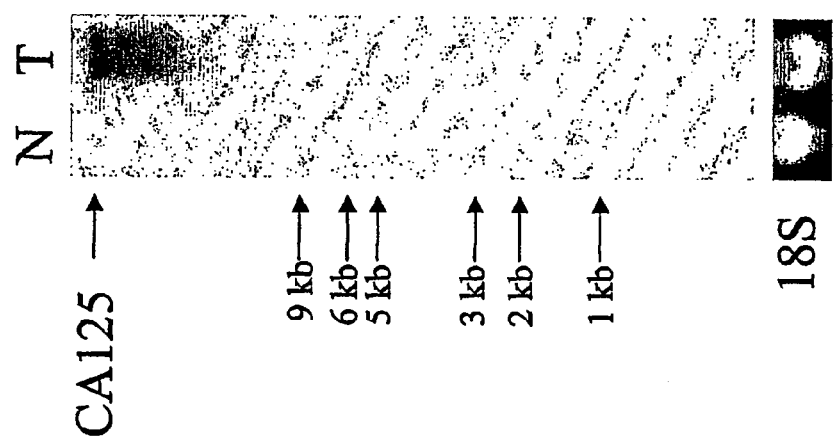
FIG. 6 illustrates a Northern blot analysis of RNA derived from either normal ovary (N) or ovarian carcinoma (T) probed with a $P^{32}$ cDNA repeat sequence of CA125. Total RNA samples (10 μg) were size separated by electrophoresis on a formaldehyde 1.2% agarose gel. After blotting to Hybond N, the lanes were probed with $P^{32}$ radiolabelled 400 bp repeat (see FIG. 2). Lane 1 represents RNA from normal ovarian tissue, and lane 2 represents RNA from serous ovarian tumor tissue.
Figure 7A:
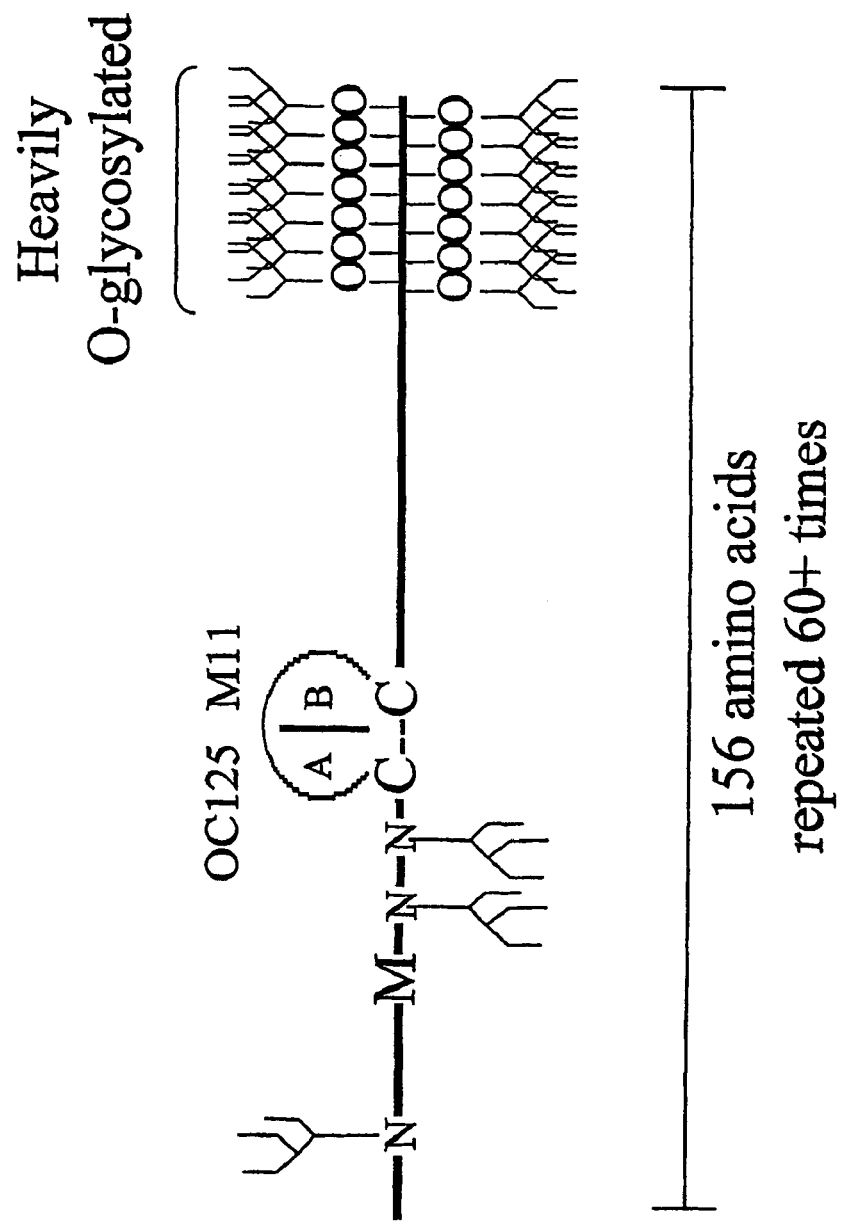
FIG. 7A is a schematic diagram of a typical repeat unit for CA125 showing the N-glycosylation sites at the amino end and the totally conserved methionine (M). Also shown is the proposed cysteine enclosed loop with antibody binding sites for OC125 and M11. Also noted are the highly O-glycosylated residues at the carboxy end of the repeat.

The cDNA for AK024365 allowed alignment of four additional repeats as well as a downstream carboxy terminus sequence of the CA125 gene. Table 8 illustrates the complete DNA sequence of 13 repeats contiguous with the carboxy terminus of the CA125 molecule, which corresponds to SEQ ID NO: 49. Table 9 illustrates the complete amino acid sequence of the 13 repeats and the carboxy terminus of the CA125 molecule, which corresponds to SEQ ID NO: 50. The carboxy terminus domain was further confirmed by the existence of two EST's (Genbank Accession Nos. AW150602 and AI923224) in the genebank database, both of which confirmed the stop-codon indicated (TGA) as well as the poly A signal sequence (AATAA) and the poly A tail (see Table 9). The presence of these repeats has been confirmed in serous ovarian tumors and their absence in normal ovarian tissue and mucinous tumors as expected (see FIG. 2A). Also, the transcripts for these repeats have been shown to be present in tumor cell lines derived from ovarian tumors, but not in normal lymphocyte cell lines (FIG. 2B). Moreover, Northern blot analysis of mRNA derived from normal or ovarian carcinoma and probed with a $P^{32}$ labeled CA125 repeat sequence (as shown in FIG. 6) confirmed the presence of an RNA transcript in excess of 20 kb in ovarian tumor extracts (see FIG. 2B).

Figure 3:
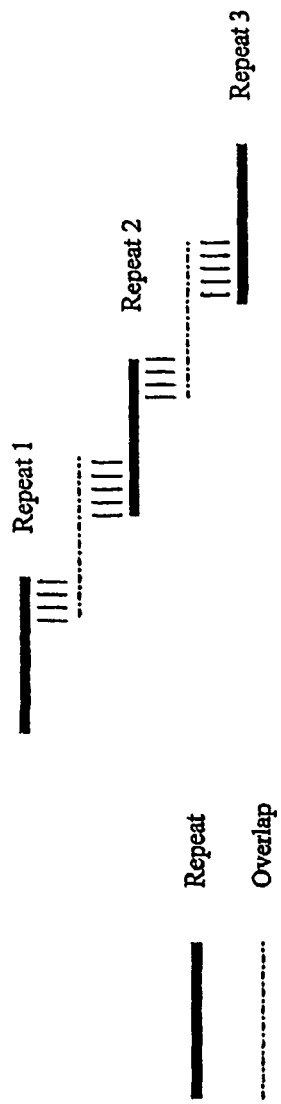
FIG. 3 illustrates repeat sequences determined by sequencing cloned cDNA from the 400 b band in FIG. 2B. Placing of repeat sequences in a contiguous fashion was accomplished by PCR amplification and sequencing of overlap areas between two repeat sequences. A sample of the complete repeat sequences is shown in SEQ ID NOS: 158, 159, 160, and 161, which was obtained in this manner and placed next to each other based on overlap sequences. The complete list of repeat sequences that was obtained is shown in Table 21 (SEQ ID NO: 162).

To date, 45 repeat sequences have been identified with high homology to each other. To order these repeat units, overlapping sequences were amplified using a sense primer (5' GTC TCT ATG TCA ATG GTT TCA CCC-3') (SEQ ID NO: 305) from an upstream repeat and an antisense primer from a downstream repeat sequence (antisense 5' TAG CTG CTC TCT GTC CAG TCC-3') (SEQ ID NO: 306). Attempts have been made to place these repeats in a contiguous fashion as shown in FIG. 3. There is some potential redundancy. Further, there is evidence from overlapping sequences that some repeats exist in more than one location in the sequence giving a total of more than 60 repeats in the CA125 molecule (see Table 21 SEQ ID NO: 162).

Final confirmation of the relationship of the putative CA125 repeat domain to the known CA125 molecule was achieved by expressing a recombinant repeat domain in *E. coli*. In FIG. 4, expression of a recombinant CA125 repeat domain is shown in lane 2 compared to the vector alone in lane 1, Panel D. A series of Western blots representing *E. coli* extracts of vector alone in lane 1; CA125 recombinant protein lane in 2 and recombinant TADG-14 (an unrelated recombinant protease), lane 3, were probed with the CA125 antibodies M11, Panel A; OC125, Panel B; and ISOBM 9.2, Panel C. In all cases, CA125 antibodies recognized only the recombinant CA125 antigen (lane 2 of each panel).

Figure 5:
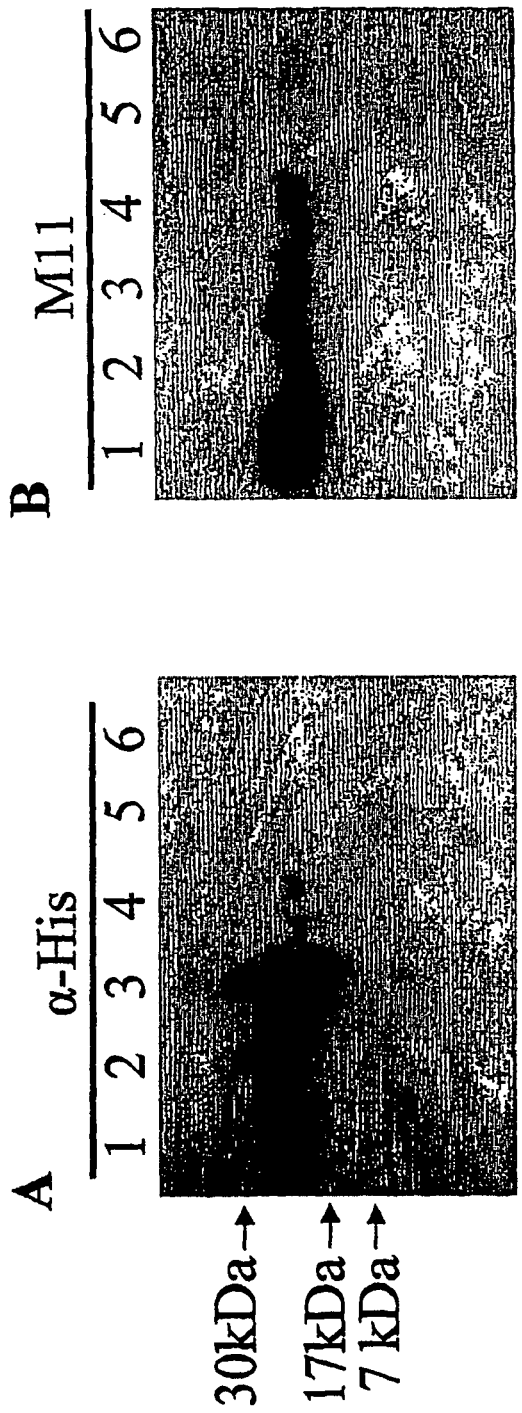
FIG. 5 represents Western blots of the CA125 repeat sequence that were generated to determine the position of the M11 epitope within the recombinant CA125 repeat. The expressed protein was bound to Ni-NTA agarose beads. The protein was left undigested or digested with Asp-N or Lys-C. The protein remaining bound to the beads was loaded into lanes 1, 2, or 3 corresponding to undigested, Asp-N digested and Lys-C digested, respectively. The supernatants from the digestions were loaded in lanes 4, 5, and 6 corresponding to undigested, Asp-N digested and Lys-C digested, respectively. The blots were probed with either anti-His tag antibody (A) or M11 antibody (B). Panel C shows a typical repeat sequence corresponding to SEQ ID NO: 150 with each exon defined by arrows. All proteolytic aspartic acid and lysine sites are marked with overhead arrow or dashes. In the lower panel, the O-glycosylation sites in exons 4 and 5 are marked with 0, the N-glycosylation sites are marked with X plus the amino acid number in the repeat (#12, 33, and 49) the conserved methionine is designated with M plus the amino acid number (M#24), and the cysteine enclosure which is also present in all repeats and encompasses 19 amino acids between the cysteines is marked with C-C (amino acids #59-79). The epitopes for M11 and OC125 are located in the latter part of the C-enclosure or downstream from the C-enclosure.

To further characterize the epitope location of the CA125 antibodies, recombinant CA125 repeat was digested with the endoprotease Lys-C and separately with the protease Asp-N. In both cases, epitope recognition was destroyed. As shown in FIG. 5, the initial cleavage site for ASP-N is at amino acid #76 (indicated by arrow in FIG. 5C). This sequence (amino acids #1-76), a 17 kDa band, was detected with anti-histidine antibodies (FIGS. 5A, Lane 3) and found to have no capacity to bind CA125 antibodies (FIG. 5B, Lane 3). The upper bands in FIGS. 5A and 5B represent the undigested remaining portion of the CA125 recombinant repeat. From these data, one can reasonably conclude that epitopes are either located at the site of cleavage and are destroyed by Asp-N or are downstream from this site and also destroyed by cleavage. Likewise, cleavage with Lys-C would result in a peptide, which includes amino acids #68-154 (FIG. 5C) and again, no antibody binding was detected. In view of the foregoing, it seems likely that epitope binding resides in the cysteine loop region containing a possible disulfide bridge (amino acids #59-79). Final confirmation of epitope sites are being examined by mutating individual amino acids.

To determine transcript size of the CA125 molecule, Northern blot analysis was performed on mRNA extracts from both normal and tumor tissues. In agreement with the notion that CA125 may be represented by an unusually large transcript due to its known mega dalton size in tumor sera, ascites fluid, and peritoneal fluid [Nustad K et al., CA125-epitopes and molecular size, *Int. J of Biolog. Markers,* 13(4) 196-199 (1998)], a transcript was discovered which barely entered the gel from the holding well (FIG. 6). CA125 mRNA was only present in the tumor RNA sample and while a precise designation of its true size remains difficult due to the lack of appropriate standards, its unusually large size would accommodate a protein core structure in excess of 11,000 amino acids.

Evidence demonstrates that the repeat domain of the CA125 molecule encompasses a minimum of 45 different 156 amino acid repeat units and possibly greater than 60 repeats, as individual repeats occur more than once in the sequence. This finding may well account for the extraordinary size of the observed transcript. The amino acid composition of the repeat units (FIGS. 7A, 7C-F, Table 21) indicates that the sequence is rich in serine, threonine, and proline typical of the high STP repeat regions of the mucin genes [Gum Jr., JR, Mucin genes and the proteins they encode: Structure, diversity and regulation, *Am J Respir. Cell Mol. Biol.* 7:557-564 (1992)]. Results suggest that the downstream end of the repeat is heavily glycosylated.

Also noteworthy is a totally conserved methionine at position 24 of the repeat (FIGS. 7A, 7C-F). It is this methionine which allowed cyanogen bromide digestion of the CA125 molecule, resulting in the 40 kDa glycopeptide that was identified with OC125 and M11 antibodies in Western blots of the CNBr digested peptides. These data predict that the epitopes for the CA125 antibodies are located in the repeat sequence.

By production of a recombinant product representing the repeat sequence, results have confirmed this to be true. A potential disulfide bond is noted, which would encompass a C-enclosure comprising 19 amino acids enclosed by two cysteines at positions #59 and #79. The cysteines are totally conserved, which suggest a biological role for the resulting putative C-enclosure in each repeat. As mentioned above, it is likely that the OC125 and M11 epitopes are located in the C-enclosure, indicating its relative availability for immune detection. This is probably due to the C-enclosure structure and the paucity of glycosylation in the immediate surrounding areas. Domain searches also suggest some homology in the repeat domain to an SEA domain commonly found in the mucin genes [Williams S J et al., MUC13, a novel human cell surface mucin expressed by epithelial and hemopoietic cells, *J of Biol. Chem.* 276(21)18327-18336 (2001)] beginning at amino acid #1 and ending at #131 of each repeat. No biological function has been described for this domain.

Based on homology of the repeat sequences to chromosome 19q 13.2 (cosmid #AC008734) and confirmed by genomic amplification, it has been established that each repeat is comprised of 5 exons (covering approximately 1900 bases of genomic DNA): exon 1 comprises 42-amino acids (#1-42); exon 2 comprises 23 amino acids (#43-65); exon 3 comprises 58 amino acids (#66-123); exon 4 comprises 12 amino acids (#124-135); and exon 5 comprises 21 amino acids (#136-156) (see FIG. 7B). Homology pile-ups of individual exons have also been completed (see FIGS. 7C-F), which indicates that exon 1 has a minimum of 31 different copies of the exon; exon 2 has 27 copies; exon 3 has 28 copies, exon 4 has 28 copies and exon 5 has 21 copies. If all exons were only found in a single configuration relative to each other, one could determine that a minimum number of repeats of 31 were present in the CA125 molecule. Using the exon 2 pile-up data as an example, it has been established as mentioned above that there are 27 individual exon 2 sequences. Using exon 2, which was sequenced fully in both the repeat units and the overlaps, results established that a minimum of 45 repeat units are present when exon 2 is combined with unique other exon combinations. However, based on overlap sequence information, 60+ repeat units are likely present in the CA125 molecule (Table 21). This larger number of repeat units can be accounted for by the presence of the same repeat unit occurring in more than one location.

Currently, the repetitive units of the repeat domain of the CA125 molecule constitute the majority of its extracellular molecular structure. These sequences have been presented in a tandem fashion based on overlap sequencing data. Some sequences may be incorrectly placed and some repeat units may not as yet be identified (Table 21). More recently, an additional repeat was identified in CA125 as shown in Tables 22 and 23 (SEQ. ID NOS: 307 and 308). The exact position has not yet been identified. Also, there is a potential that alternate splicing and/or mutation could account for some of the repeat variants that are listed. Studies are being conducted to compare both normal tissue derived CA125 repeats to individual tumor derived CA125 repeats to determine if such variation is present. Currently, the known exon configurations would easily accommodate the greater than 60 repeat units as projected. It is, therefore, unlikely that alternate splicing is a major contributor to the repetitive sequences in CA125. It should also be noted that the genomic database for chromosome 19q 13.2 only includes about 10 repeat units, thus indicating a discrepancy between the data of the present invention (more than 60 repeats) and the genomic database. A recent evaluation of the methods used for selection and assembly for genomic sequence [Marshall E, DNA Sequencing: Genome teams adjust to shotgum marriage, *Science* 292: 1982-1983 (2001)] reports that "more research is needed on repeat blocks of almost identical DNA sequence which are more common in the human genome. Existing assembly programs can't handle them well and often delete them." The CA125 repeat units located on chromosome 19 may well be victims of deletion in the genomic database, thus accounting for most CA125 repeat units absent from the current databases.

A. Sequence Confirmation and Assembly of the Amino Terminal Domain (Domain 1) of the CA125 Molecule As previously mentioned, homology for repeat sequences was found in the chromosome 19 cosmid AC008734 of the GCG database. This cosmid at the time consisted of 35 unordered contigs. After searching the cosmid for repeat sequences, contig #32 was found to have exons 1 and 2 of a repeat unit at its 3' end. Contig #32 also had a large open reading frame upstream from the two repeat units, which suggested that this contig contained sequences consistent with the amino terminal end of the CA125 molecule. A sense primer was synthesized to the upstream non-repeat part of contig #32 coupled with a specific primer from within the repeat region (see Methods). PCR amplification of ovarian tumor cDNA confirmed the contiguous positioning of these two domains.

The PCR reaction yielded a band of approximately 980 bp. The band was sequenced and found to connect the upstream open reading frame to the repeat region of CA125. From these data, more primer sets (see Methods) were synthesized and used in PCR reactions to piece together the entire open reading frame contained in contig #32. To find the 5' most end of the sequence, an EST (AU133673) was discovered, which linked contig #32 to contig #7 of the same cosmid. Specific primers were synthesized, (5'-CTGATGGCATTATGGAA-CACATCAC-3' (SEQ ID NO: 59) and 5'-CCCAGAAC-GAGAGACCAGTGAG-3' (SEQ ID NO: 60)), to the EST and contig #32. A PCR reaction was performed to confirm that part of the EST sequence was in fact contiguous with contig #32. Confirmation of this contiguous 5' prime sequencing strategy using overlapping sequences allowed the assembly of the 5' region (Domain 1) (FIG. 8A). 5' RACE PCR was performed on tumor cDNA to confirm the amino terminal sequence to CA125. The test confirmed the presence of contig #7 sequence at the amino terminal end of CA125.

Figure 8A:
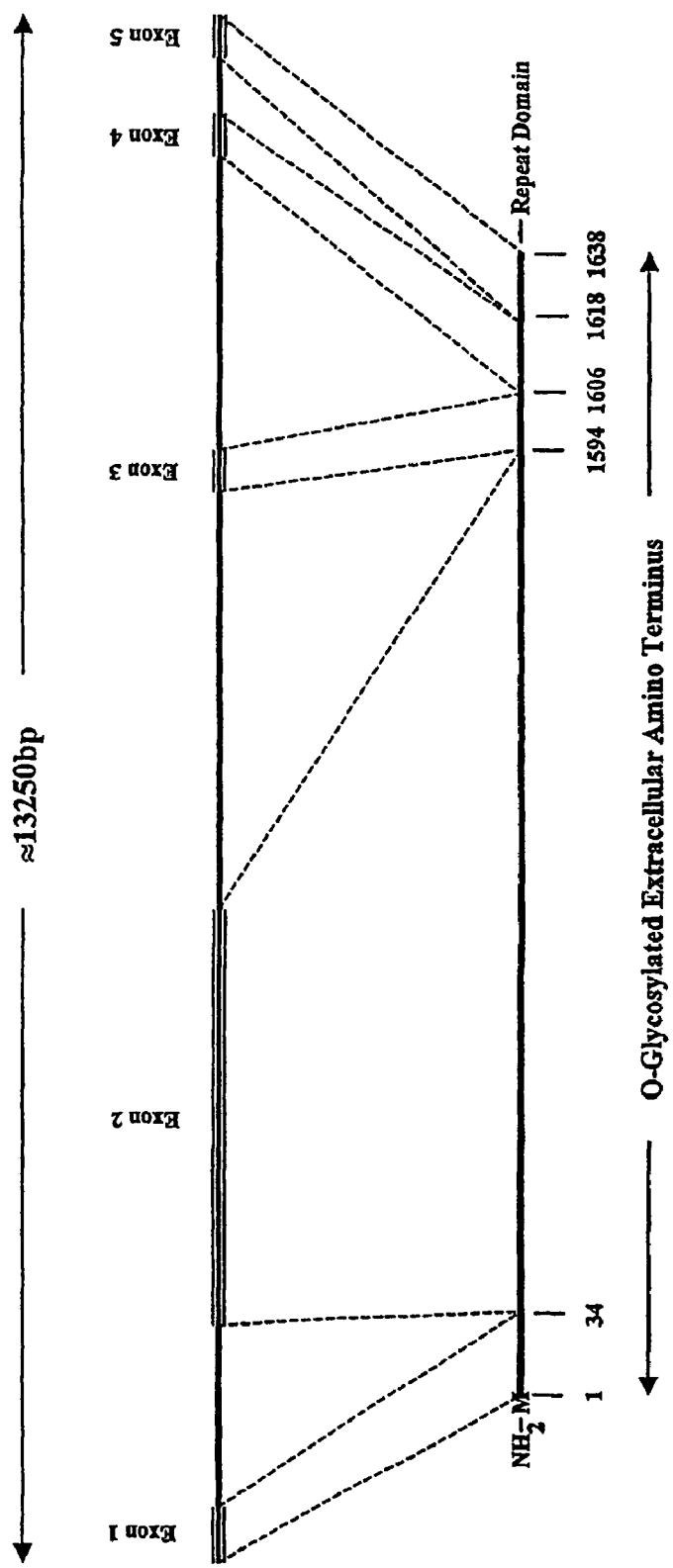
FIG. 8A shows the genomic structure of the amino terminal end of the CA125 gene. It also indicates the amino composition of each exon in the extracellular domain.

The amino terminal domain comprises five genomic exons covering approximately 13,250 bp. Exon 1, a small exon, (amino acids #1-33) is derived from contig #7 (FIG. 8A). The remaining exons are all derived from contig #32: Exon 2 (amino acids #34-1593), an extraordinarily large exon, Exon 3 (amino acids #1594-1605), Exon 4 (amino acids #1606-1617) and Exon 5 (amino acids #1618-1637) (see FIG. 8A).

Potential N-glycosylation sites marked (x) are encoded at positions #81, #271, #320, #624, #795, #834, #938, and #1,165 (see FIG. 8B). O-glycosylation sites are extraordinarily abundant and essentially cover the amino terminal domain (FIG. 8B). As shown by the O-glycosylation pattern, Domain 1 is highly enriched in both threonine and serine (FIG. 8B).

With additional research, an extension of the glycosylated amino terminal sequence was identified and cloned. Table 24 (SEQ ID NO: 309) illustrates the DNA sequence of the CA125 amino terminal extension. Table 25 (SEQ ID NO: 310) illustrates the protein sequence for the amino terminal extension of the CA125 gene. It should be noted that the last four amino acids, TDGI, in SEQ ID NO: 310 belong to exon 1 of the amino terminal domain. Table 26 illustrates the serine/threonine o-glycosylation pattern for the CA125 amino terminal extension.

B. Sequence Confirmation and Assembly of the CA125 Carboxy Terminal End (Domain 3)

Figure 9A:
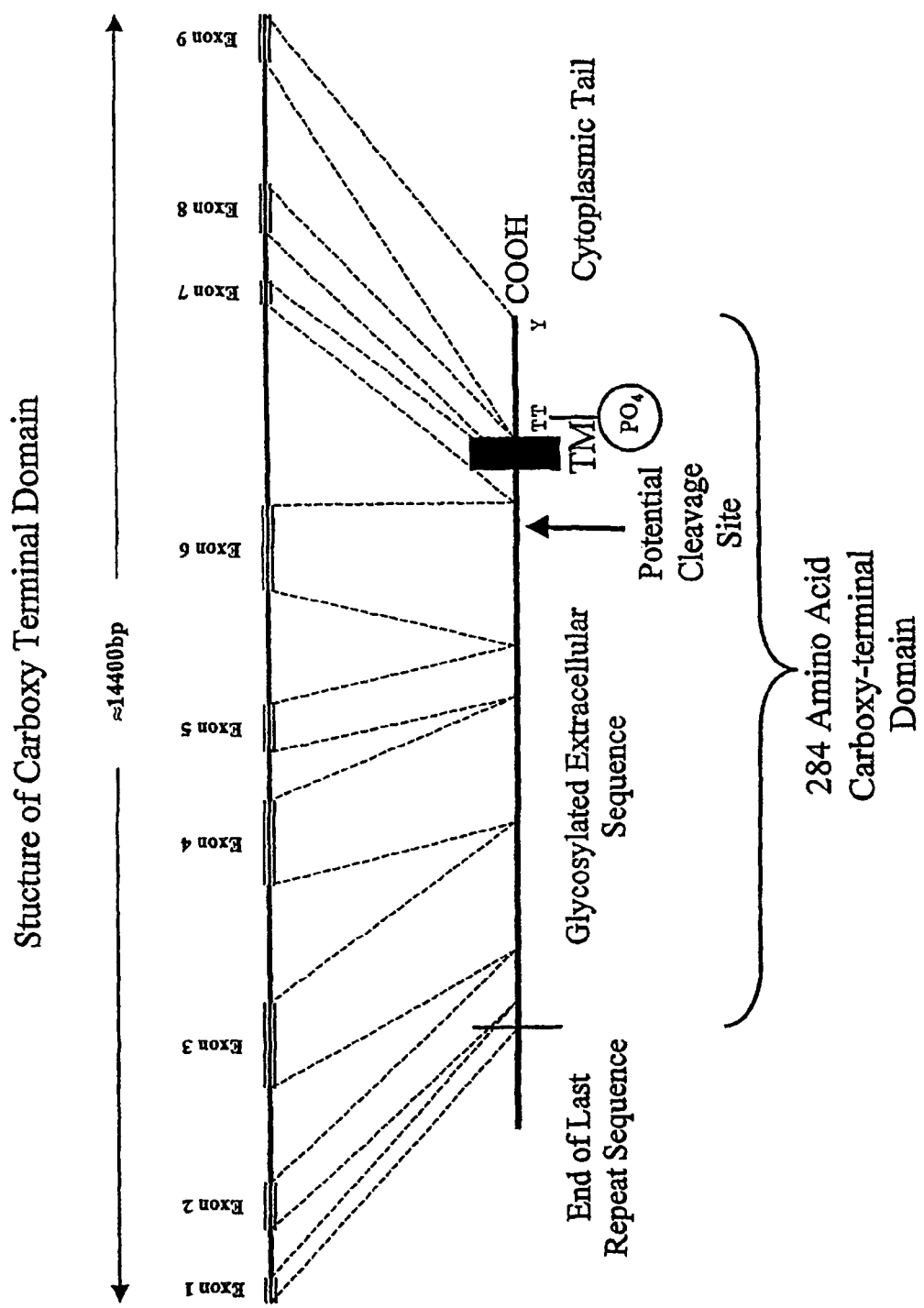
FIG. 9A illustrates the genomic exon structure of the carboxy-terminal domain of the CA125 gene. It includes a diagram showing the extracellular portion, the potential cleavage site, the transmembrane domain and the cytoplasmic tail.

A search of Genbank using the repeat sequences described above uncovered a cDNA sequence referred to as Genbank accession number AK024365. This sequence was found to have 2 repeat sequences, which overlapped 2 known repeat sequences of a series of 6 repeats. As a result, the cDNA allowed the alignment of all six carboxy terminal repeats along with a unique carboxy terminal sequence. The carboxy terminus was further confirmed by the existence of two other ESTs (Genbank accession numbers AW150602 and A11923224), both of which confirmed a stop codon as well as a poly-A signal sequence and a poly-A tail (see GCG database #AF414442). The sequence of the carboxy terminal domain was confirmed using primers designed to sequence just downstream of the repeat domain (sense primer 5' GGA CAA GGT CAC CAC ACT CTA C-3') (SEQ ID NO: 303) and an antisense primer (5'-GCA GAT CCT CCA GGT CTA GGT GTG-3') (SEQ ID NO: 304) designed to carboxy terminus (FIG. 9A).

The carboxy terminal domain covers more than 14,000 genomic bp. By ligation, this domain comprises nine exons as shown in FIG. 9A. The carboxy-terminus is defined by a 284 amino acid sequence downstream from the repeat domains (see FIG. 9B). Both N-glycosylation sites marked (x) (#31, #64, #103, #140, #194, #200) and a small number of O-glycosylation sites marked (o) are predicted for the carboxy end of the molecule (FIGS. 9A, 9B). Of special note is a putative transmembrane domain at positions #230-#252 followed by a cytoplasmic domain, which is characterized by a highly basic sequence adjacent to the membrane (#256-#260) as well as several potential S/T phosphorylation sites (#254, #255, #276) and tyrosine phosphorylation sites (at #264, #273, #274) (FIGS. 9A, 9B).

Figure 10:
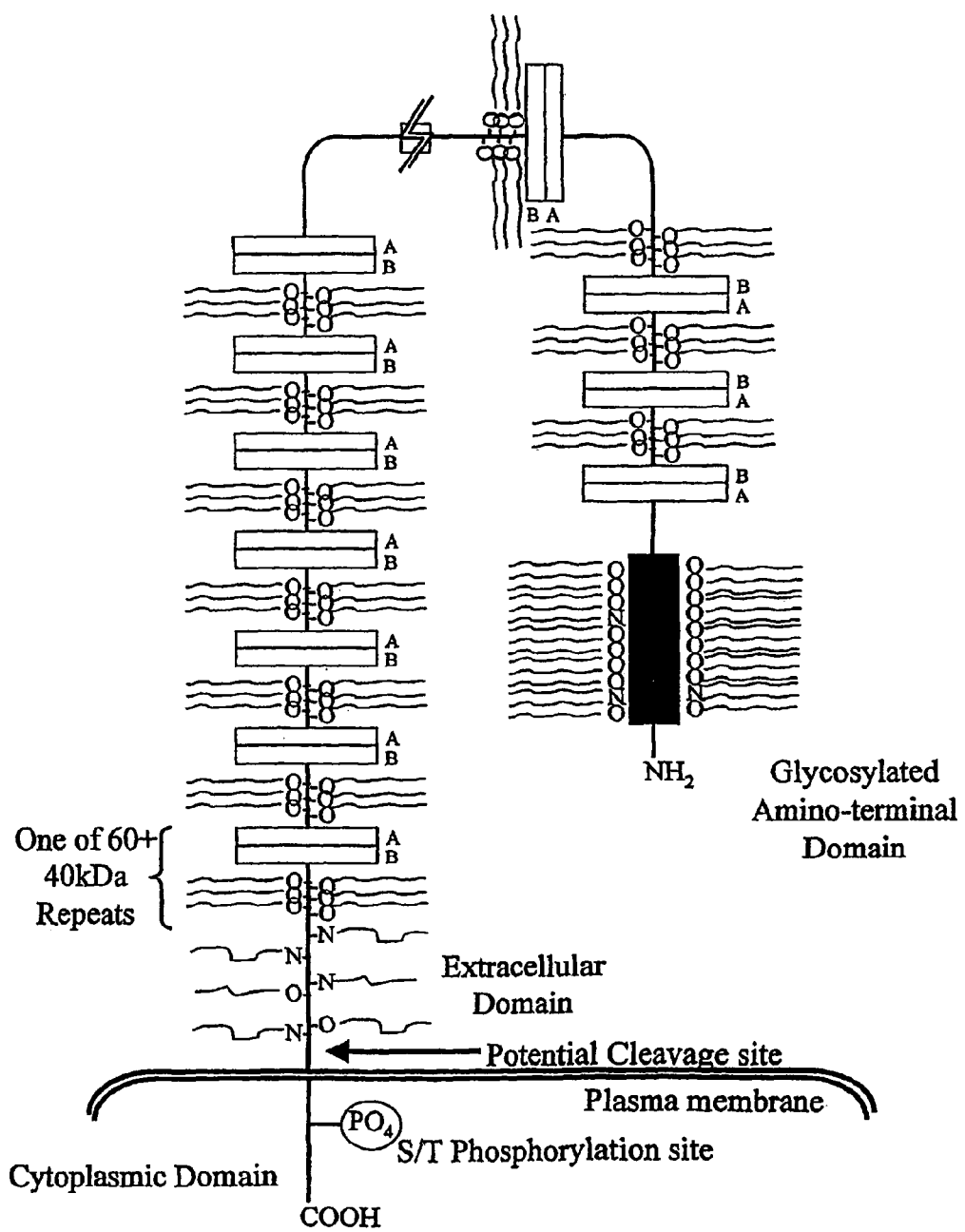
FIG. 10 illustrates the proposed structure of the CA125 molecule based on the open reading frame sequence described herein. As shown, the molecule is dominated by a major repeat domain in the extracellular space along with a highly glycosylated amino terminal repeat. The molecule is anchored by a transmembrane domain and also includes a cytoplasmic tail with potential for phosphorylation.
Figure 11:
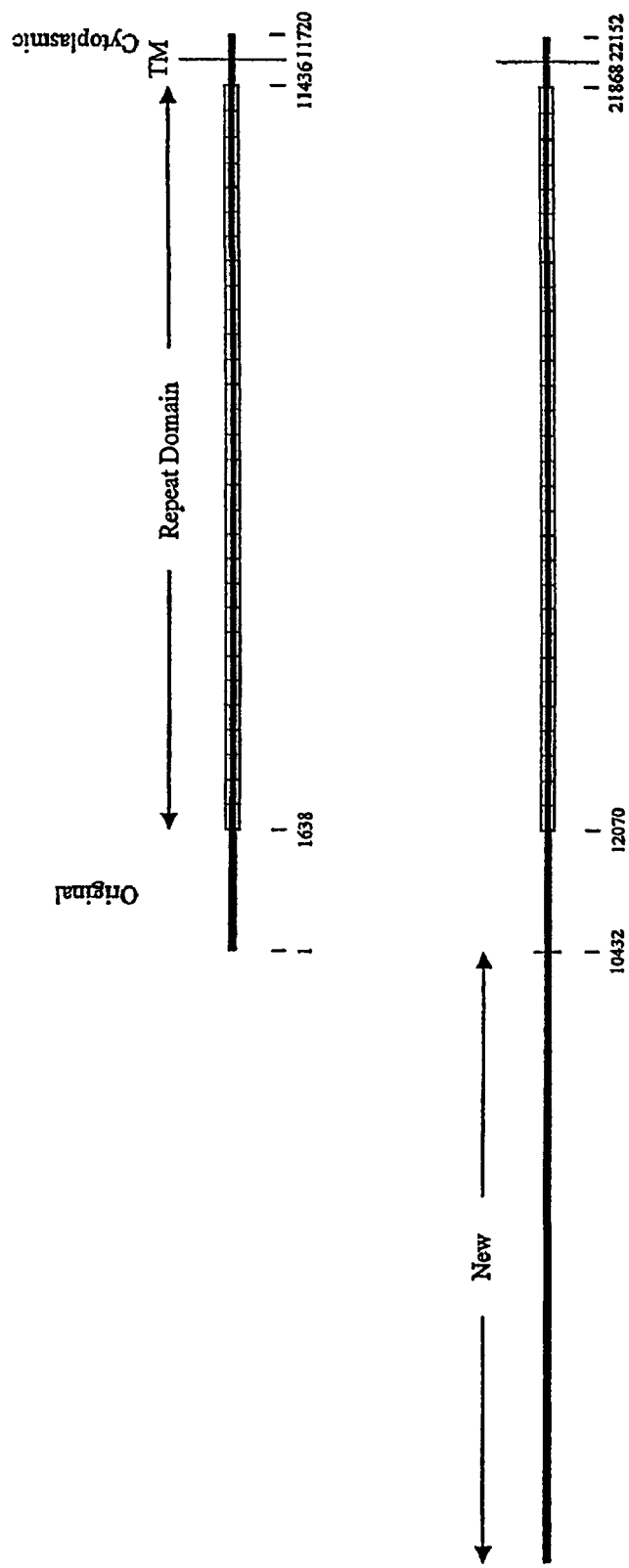
FIG. 11 is a diagram of the CA125 gene showing the originally cloned domains of both the genomic and amino acid sequences and the extension of the glycosylated amino terminal protein sequence.

Assembly of the CA125 molecule as validated by PCR amplification of overlap sequence provides a picture of the whole molecule (see FIG. 10 and Table 21). The complete nucleotide sequence is available in Genebank, Accession #AF414442 and the amino acid sequence as currently aligned is shown in Table 21.

Discussion

The CA125 molecule comprises three major domains; an extracellular amino terminal domain (Domain 1), a large multiple repeat domain (Domain 2) and a carboxy terminal domain (Domain 3), which includes a transmembrane anchor with a short cytoplasmic domain (FIG. 10). The amino terminal domain is assembled by combining five genomic exons, four very short amino terminal sequences and one extraordinarily large exon, which often typifies mucin extracellular glycosylated domains [Desseyn J L et al., Human mucin gene MUC5B, the 10.7-kb large central exon encodes various alternate subdomains resulting in a super-repeat. Structural evidence for a 11p15.5 gene family, *J. Biol. Chem.* 272(6):3168-3178 (1997)]. This domain is dominated by its capacity for O-glycosylation and its resultant richness in serine and threonine residues. Overall, the potential for O-glycosylation essentially covers this domain and, as such, may allow the carbohydrate superstructure to influence ECM interaction at this end of the CA125 molecule (FIG. 8). There is one short area (amino acids #74-120) where little or no glycosylation is predicted, which could allow for protein-protein interaction in the extracellular matrix.

Efforts to purify CA125 over the years were obviously complicated by the presence of this amino terminal domain, which is unlikely to have any epitope sites recognized by the OC125 or M11 class antibodies. As the CA125 molecule is degraded in vivo, it is likely that this highly glycosylated amino terminal end will be found associated with varying numbers of repeat units. This could very well account for both the charge and size heterogeneity of the CA125 molecule so often identified from serum and ascites fluid. Also of note are two T-TALK sequences at amino acids #45-58 (underlined in FIG. 8B), which are unique to the CA125 molecule.

The extracellular repeat domain, which characterizes the CA125 molecule, also represents a major portion of the molecular structure. It is downstream from the amino terminal domain and presents itself in a much different manner to its extracellular matrix neighbors. These repeats are characterized by many features including a highly-conserved nature (FIG. 3) and a uniformity in exon structure (FIG. 7). But most consistently, a cysteine enclosed sequence may form a cysteine loop (Table 21). This structure may provide extraordinary potential for interaction with neighboring matrix molecules. Domain 2 encompasses the 156 amino acid repeat units of the CA125 molecule. The repeat domain constitutes the largest proportion of the CA125 molecule (Table 21 and FIG. 10). Because it has been known for more than 15 years that antibodies bind in a multivalent fashion to CA125, it has been predicted that the CA125 molecule would include multiple repeat domains capable of binding the OC125 and M11 class of sentinel antibodies which define this molecule [O'Brien et al., New monoclonal antibodies identify the glycoprotein carrying the CA125 epitope, *Am J Obstet. Gynecol.* 165:1857-1964 (1991); Nustad K et al., Specificity and affinity of 26 monoclonal antibodies against the CA125 antigen: First report from the ISOBM TD-1 workshop, *Tumor Biology* 17:196-219 (1996); and Bast R C et al., A radioimmunoassay using a monoclonal antibody to monitor the course of epithelial ovarian cancer, *N. Engl. J. Med.* 309:883-887 (1983)]. In the present invention, more than 60 repeat units have been identified, which are in tandem array in the extracellular portion of the CA125 molecule. Individual repeat units have been confirmed by sequencing and further identified by PCR amplification of the overlapping repeat sequences. Results confirm the contiguous placement of most repeats relative to its neighbor (Table 21).

Initial evidence suggests that this area is a potential site for antibody binding and also for ligand binding. The highly conserved methionine and several highly conserved sequences within the repeat domain also suggests a functional capacity for these repeat units. The extensive glycosylation of exons 4 & 5 of the repeat unit and the N-glycosylation potential in exon 1 and the 5' end of exon 2 might further point to a functional capacity for the latter part of exon 2 and exon 3 which includes the C-enclosure (see FIG. 7). It should be apparent that the C-enclosure might be a prime target for protease activity and such cleavage may well explain the difficulty experienced by many investigators in obtaining an undigested CA125 parent molecule. Such activity might explain the diffuse pattern of antibody binding and the loss of antibody binding for molecules of less than 200,000 kDa. Proteolysis would destroy the epitopes and, therefore, only multiple repeats could be identified by blotting with CA125 antibodies. The repeat unit organization also suggests the potential for a multivalent interaction with extracellular entities.

The carboxy terminal domain of the CA125 molecule comprises an extracellular domain, which does not have any homology to other known domains. It encodes a typical transmembrane domain and a short cytoplasmic tail. It also contains a proteolytic cleavage site approximately 50 amino acids upstream from the transmembrane domain. This would allow for proteolytic cleavage and release of the CA125 molecule (FIG. 9). As indicated by Fendrick, et al. [CA125 phosphorylation is associated with its secretion from the WISH human amnion cell line, *Tumor Biology* 18:278-289 (1997)], release of the CA125 molecule is preceded by phosphorylation and sustained by inhibitors of phosphatases, especially inhibition of phosphatase 2B. The cytoplasmic tail which contains S/T phosphorylation sites next to the transmembrane domain and tyrosine phosphorylation sites downstream from there could accommodate such phosphorylation. A very distinguishable positively charged sequence is present upstream from the tyrosine, suggesting a signal transduction system involving negatively charged phosphate groups and positively charged lysine and arginine groups.

These features of the CA125 molecule suggest a signal transduction pathway involvement in the biological function of CA125 [Fendrick J L et al., CA125 phosphorylation is associated with its secretion from the WISH human amnion cell line, *Tumor Biology* 18:278-289 (1997); and Konish I et al., Epidermal growth factor enhances secretion of the ovarian tumor-associated cancer antigen CA125 from the human amnion WISH cell line, *J Soc. Gynecol. Invest.* 1:89-96 (1994)]. It also reinforces the prediction of phosphorylation prior to CA125 release from the membrane surface as previously proposed [Fendrick J L et al., CA125 phosphorylation is associated with its secretion from the WISH human amnion cell line, *Tumor Biology* 18:278-289 (1997); and Konish I et al., Epidermal growth factor enhances secretion of the ovarian tumor-associated cancer antigen CA125 from the human amnion WISH cell line, *J Soc. Gynecol. Invest.* 1:89-96 (1994)]. Furthermore, a putative proteolytic cleavage site on the extra-cellular side of the transmembrane domain is present at position #176-181.

How well does the CA125 structure described in the present invention compare to the previously known CA125 structure? O'Brien et al. reported that a number of questions needed to be addressed: 1) the multivalent nature of the molecule; 2) the heterogeneity of CA125; 3) the carbohydrate composition; 4) the secretory or membrane bound nature of the CA125 molecule; 5) the function of the CA125 molecule; and 6) the elusive CA125 gene [More than 15 years of CA125: What is known about the antigen, its structure and its function, *Int J Biological Markers* 13(4)188-195 (1998)]. Several of these questions have been addressed in the present invention including, of course, the gene and its protein core product. Perhaps, most interestingly is the question of whether an individual large transcript accounted for the whole CA125 molecule, or a number of smaller transcripts which represented subunits that specifically associated to produce the CA125 molecule. From the results produced by way of the present invention, it is now apparent that the transcript of CA125 is large—similar to some of the mucin gene transcripts e.g. MUC 5B [see Verma M et al., Mucin genes: Structure, expression and regulation, *Glycoconjugate J.* 11:172-179 (1994); and Gendler S J et al., Epithelial mucin genes, *Annu. Rev. Physiol.* 57:607-634 (1995)]. The protein core extracellular domains all have a high capacity for O-glycosylation and, therefore, probably accounts for the heterogeneity of charge and size encountered in the isolation of CA125. The data also confirm the O-glycosylation inhibition data, indicating CA125 to be rich in O-glycosylation [Lloyd K O et al., Synthesis and secretion of the ovarian cancer antigen CA125 by the human cancer cell line NIH: OVCAR-3, *Tumor Biology* 22, 77-82 (2001); Lloyd K O et al., Isolation and characterization of ovarian cancer antigen CA125 using a new monoclonal antibody (VK-8): Identification as a mucin-type molecule, *Int. J. Cancer,* 71:842-850 (1997); and Fendrick J L et al., Characterization of CA125 synthesized by the human epithelial amnion WISH cell line, *Tumor Biology* 14:310-318 (1993)].

The repeat domain which includes more than 60 repeat units accounts for the multivalent nature of the epitopes present, as each repeat unit likely contains epitope binding sites for both OC125-like antibodies and M11-like antibodies. The presence of a transmembrane domain and cleavage site confirms the membrane association of CA125, and reinforces the data which indicates a dependence of CA125 release on proteolysis. Also, the release of CA125 from the cell surface may well depend on cytoplasmic phosphorylation and be the result of EGF signaling [Nustad K et al., Specificity and affinity of 26 monoclonal antibodies against the CA125 antigen: First report from the ISOBM TD-1 workshop, *Tumor Biology* 17:196-219 (1996)]. As for the question of inherent capacity of CA125 for proteolytic activity, this does not appear to be the case. However, it is likely that the associated proteins isolated along with CA125 (e.g. the 50 kDa protein which has no antibody binding ability) may have proteolytic activity. In any case, proteolysis of an extracellular cleavage site is the most likely mechanism of CA125 release. Such cleavage would be responsive to cytoplasmic signaling and mediated by an associated extracellular protease activity.

In summary, the large number of tandem repeats of the CA125 molecule, which dominate its molecular structure and contain the likely epitope binding sites of the CA125 molecule, was unexpected. Also, one cannot as yet account for the proteolytic activity, which has plagued the isolation and characterization of this molecule for many years. While no protease domain per se is constituitively part of the CA125 molecule, there is a high likelihood of a direct association by an extracellular protease with the ligand binding domains of the CA125 molecule. Finally, what is the role of the dominant repeat domain of this extracellular structure? Based on the expression data of CA125 on epithelial surfaces and in glandular ducts, it is reasonable to conclude that the unique structure of these repeat units with their cysteine loops plays a role both as glandular anti-invasive molecules (bacterial entrapment) and/or a role in anti-adhesion (maintaining patency) between epithelial surfaces and in ductal linings.

Recently, Yin and Lloyd described the partial cloning of the CA125 antigen using a completely different approach to that described in the present invention [Yin T W T et al., Molecular cloning of the CA125 ovarian cancer antigen. Identification as a new mucin (MUC16), *J Biol. Chem.* 276:27371-27375 (2001)]. Utilizing a polyclonal antibody to CA125 to screen an expression library of the ovarian tumor cell line OVCAR-3, these researchers identified a 5965 bp clone containing a stop codon and a poly A tail, which included nine partially conserved tandem repeats followed by a potential transmembrane region with a cytoplasmic tail. The 5965 bp sequence is almost completely homologous to the carboxy terminus region shown in Table 21. Although differing in a few bases, the sequences are homologous. As mentioned above, the cytoplasmic tail has the potential for phosphorylation and a transmembrane domain would anchor this part of the CA125 molecule to the surface of the epithelial or tumor cell. In the extracellular matrix, a relatively short transition domain connects the transmembrane anchor to a series of tandem repeats—in the case of Yin and Lloyd, nine.

By contrast, the major extracellular part of the molecule of the present invention as shown is upstream from the sequence described by Yin and includes a large series of tandem repeats. These results, of course, provide a different picture of the CA125 molecule, which suggest that CA125 is dominated by the series of extracellular repeats. Also included is a major amino terminal domain (~1638 amino acids) for the CA125 molecule, which it is believed accounts for a great deal of the O-glycosylation known to be an important structural component of CA125.

In conclusion, a CA125 molecule is disclosed which requires a transcript of more than 35,000 bases and occupies approximately 150,000 bp on chromosome 19q 13.2. It is dominated by a large series of extracellular repeat units (156 amino acids), which offer the potential for molecular interactions especially through a highly conserved unique cysteine loop. The repeat units also include the epitopes now well-described and classified for both the major class of CA125 antibodies (i.e., the OC125 and the M11 groups). The CA125 molecule is anchored at its carboxy terminal through a transmembrane domain and a short cytoplasmic tail. CA125 also contains a highly glycosylated amino terminal domain, which includes a large extracellular exon typical of some mucins. Given the massive repeat domain presence of both epithelial surfaces and ovarian tumor cell surfaces, it might be anticipated that CA125 may play a major role in determining the extracellular environment surrounding epithelial and tumor cells.

Advantages and Uses of the CA125 Recombinant Products

1) Current assays to CA125 utilize as standards either CA125 produced from cultured cell lines or from patient ascites fluid. Neither source is defined with regard to the quality or purity of the CA125 molecule. Therefore arbitrary units are used to describe patient levels of CA125. Because cut-off values are important in the treatment of patients with elevated CA125 and because many different assay systems are used clinically to measure CA125, it is relevant and indeed necessary to define a standard for all CA125 assays. Recombinant CA125 containing epitope binding sites could fulfill this need for standardization. Furthermore, new and more specific assays may be developed utilizing recombinant products for antibody production.

There are now some highly reliable computer programs that can identify peptide sequences within the primary structure of a protein that are likely to be immunogenic. Such programs can be used to identify immunogenic sequences within the inferred CA125 structure. Thus, knowledge of the nucleotide sequence of CA125 cDNA and genomic DNA can lead to the design of synthetic "epitopes" and preparation of highly specific polyclonal and monoclonal antibodies. Antibodies are useful in the development of immuno assays having diagnostic uses. Alternatively, a recombinant expression of CADS protein clearly provides an appropriate antigen for preparing specific antibodies of CA125.

2) Vaccines: Adequate data now exists [see Wagner U et al., Immunological consolidation of ovarian carcinoma recurrences with monoclonal anti-idiotype antibody ACA125: Immune responses and survival in palliative treatment, *Clin. Cancer Res.* 7:1112-1115 (2001)], which suggest and support the idea that CA125 could be used as a therapeutic vaccine to treat patients with ovarian carcinoma. Heretofore, in order to induce cellular and humoral immunity in humans to CA125, murine antibodies specific for CA125 were utilized in anticipation of patient production of anti-ideotypic antibodies, thus indirectly allowing the induction of an immune response to the CA125 molecule. With the availability of recombinant CA125, especially domains which encompass epitope binding sites for known murine antibodies and domains directly anchoring CA125 on the tumor cell, it will be feasible to more directly stimulate patients' immune systems to CA125 and as a result, extend the life of ovarian carcinoma patients as demonstrated by Wagner et al.

Figure 12:
FIG. 12 is a diagram of the contig alignment from overlapping chromosome 19 cosmids.
Figure 13:
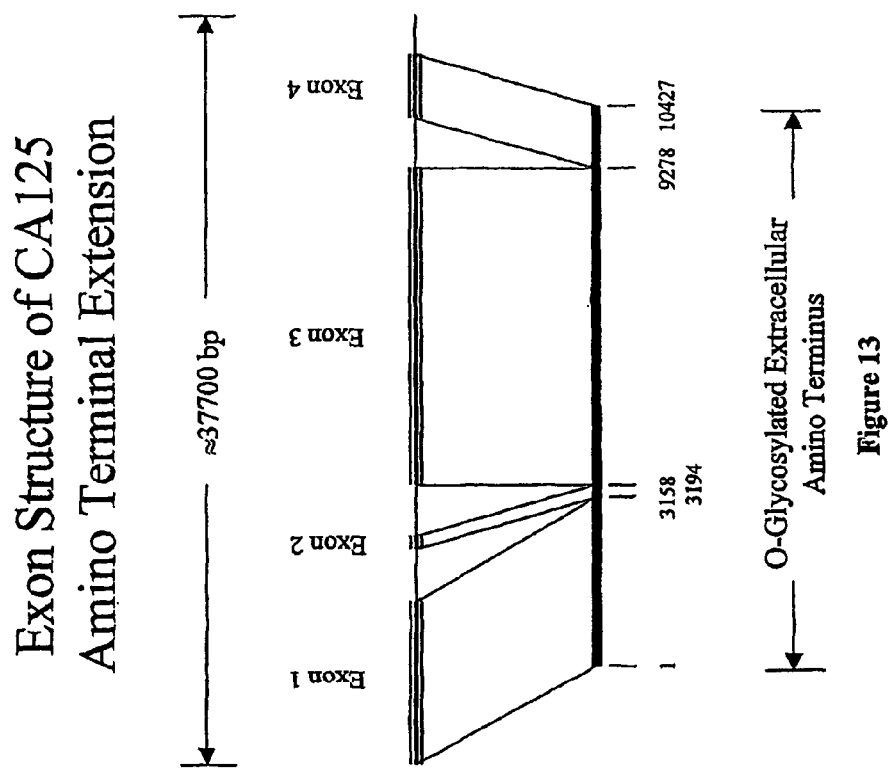
FIG. 13 illustrates the genomic exon structure of the CA125 gene amino terminal extension.

Several approaches can be utilized to achieve such a therapeutic response in the immune system by: 1) directly immunizing the patient with recombinant antigen containing the CA125 epitopes or other domains; 2) harvesting dendritic cells from the patient; 3) expanding these cells in in vitro culture; 4) activating the dendritic cells with the recombinant CA125 epitope domain or other domains or with peptides derived from these domains [see Santin A D et al., Induction of ovarian tumor-specific CD8+ cytotoxic T lymphocytes by acid-eluted peptide-pulsed autologous dendritic cells, *Obstetrics & Gynecology* 96(3):422-430 (2000)]; and then 5) returning these immune stem cells to the patient to achieve an immune response to CA125. This procedure can also be accomplished using specific peptides which are compatible with histocompatibility antigens of the patient. Such peptides compatible with the HLA-A2 binding motifs common in the population are indicated in FIG. 12.

3) Therapeutic Targets: Molecules, which are expressed on the surface of tumor cells as CA125 is, offer potential targets for immune stimulation, drug delivery, biological modifier delivery or any agent which can be specifically delivered to ultimately kill the tumor cells. CA125 offers such potential as a target: 1) Antibodies to CA125 epitopes or newly described potential epitopes: Most especially humanized or human antibodies to CA125 which could directly activate the patients' immune system to attack and kill tumor cells. Antibodies could be used to deliver all drug or toxic agents including radioactive agents to mediate direct killing of tumor cells. 2) Natural ligands: Under normal circumstances, molecules are bound to the CA125 molecule e.g. a 50 k dalton protein which does not contain CA125 epitopes co-purifies with CA125. Such a molecule, which might have a natural binding affinity for domains on the CA125 molecule, could also be utilized to deliver therapeutic agents to tumor cells.

4) Anti-sense therapy: CA125 expression may provide a survival or metastatic advantage to ovarian tumor cells as such antisense oligonucleotide derived from the CA125 sequence could be used to down-regulate the expression of CA125. Antisense therapy could be used in association with a tumor cell delivery system such as described above.

5) Small Molecules: Recombinant domains of CA125 also offer the potential to identify small molecules which bind to individual domains of the molecule. Small molecules either from combinatorial chemical libraries or small peptides can also be used as delivery agents or as biological modifiers.

6) Transgenic Animals/Transformed: CA125 and genomic DNA can be used to develop transgenic animal models and can be used under low stringency conditions, to clone CA125 cDNAs and genomic DNAs of other animal species (would this be worthwhile?). The CA125 cDNA can be used to prepare stable transformants. The bacterial cells could be transformed with CA125 cDNA to include these genes.

All references referred to herein are hereby incorporated by reference in their entirety.

It should be understood that various changes and modifications to the presently preferred embodiments described herein will be apparent to those skilled in the art. Such changes and modifications can be made without departing from the spirit and scope of the present invention and without diminishing its attendant advantages.

TABLE 1

Comparison of the Amino Acid Terminal Sequences and Several Internal Sequences
for the 40kD Band for CA125 glycoprotein (SEQ ID NO: 1 through SEQ ID NO: 4) to
the Nucleotide and Amino Acid Sequences for EST Genbank Accession No. AA640762
(SEQ ID NO: 5 and SEQ ID NO: 6, respectively)

```
40kDa Nterm - QHPGSRKFKTTEG                              (SEQ ID NO: 1)

Peak 68 - FLTVERVLQGL                                    (SEQ ID NO: 2)

Peak 65 - DTYVGPLY                                       (SEQ ID NO: 3)

Peak 30 - DGAANGVD                                       (SEQ ID NO: 4)

(SEQ ID NO: 5 and SEQ ID NO: 6)

1    CGTCGACCTGGCTCTAGAAAGTTTAACACCACGGAGAGAGTCCTTCAGGGTCTGCTCAGG
        R  R  P  G  S  R  K  F  N  T  T  E  R  V  L  Q  G  L  L  R

61    CCTGTGTTCAAGAACACCAGTGTTGGCCCTCTGTACTCTGGCTGCAGACTGACCTTGCTC
        P  V  F  K  N  T  S  V  G  P  L  Y  S  G  C  R  L  T  L  L

121    AGGCCCAAGAAGGATGGGGCAGCCACCAAAGTGGATGCCATCTGCACCTACCGCCCTGAT
        R  P  K  K  D  G  A  A  T  K  V  D  A  I  C  T  Y  R  P  D

181    CCCAAAAGCCCTGGACTGGACAGAGAGCAGCTATACTGGGAGCTGAGCCAGGGTGATGCA
        P  K  S  P  G  L  D  R  E  Q  L  Y  W  E  L  S  Q  G  D  A
```

TABLE 2A

Nucleotide and Amino Acid Sequences for Sense Primer 5' 3' (SEQ ID NO: 7
and SEQ ID NO: 8 respectively) and Antisense Primer 5' 3'
(SEQ ID NO: 9 and SEQ ID NO: 10 respectively) based upon Regions of
Homology for EST Genbank Accession Nos. BE005912 and AA640762)

| | |
|---|---|
| GGA GAG GGT TCT GCA GGG TC | (SEQ ID NO: 7) |
| E R V L Q G | (SEQ ID NO: 8) |
| GTG AAT GGT ATC AGG AGA GG | (SEQ ID NO: 9) |
| P L L I P F | (SEQ ID NO: 10) |

TABLE 2B

Sense and Anti-Sense Primers Used for Ordering Repeat Units
(SEQ ID NO: 301 and SEQ ID NO: 302, respectively)

| | |
|---|---|
| 5'-GTCTCTATGTCAATGGTTTCACCC-5' | (SEQ ID NO: 301) |
| 5'-TAGCTGCTCTCTGTCCAGTCC-3' | (SEQ ID NO: 302) |

TABLE 3

Amino Acid Sequence for a 400 bp Repeat in the CA125 Molecule
(SEQ ID NO: 11 thru SEQ ID NO: 21)

```
         1                                                  50
  12    ERVLQGLLRS LFKSTSVGPL YSGCRLTLLR PEKDGTATGV DAICTHHPDP   (SEQ ID NO: 11)

34    ERVLQGLLMP LFKNTSVSSL YSGCRLTLLR PEKDGAATRA DAVCTHRPDP   (SEQ ID NO: 12)

32    ERVLQGLLGP IFKNTSVGPL YSGCRLTSLR SEKDGAATGV DAICIHRLDP   (SEQ ID NO: 13)

46    ERVLQGLLGP MFKNTSVGLL YSGCRLTLLR PEKNGAATGM DAICSHRLDP   (SEQ ID NO: 14)

33    ERVLQGLLGP LFKNSSVGPL YSGCRLISLR SEKDGAATGV DAICTHHLNP   (SEQ ID NO: 15)

15    ERVLQGLLRP LFKSTSAGPL YSGCRLTLLR PEKHGAATGV DAICTLRLDP   (SEQ ID NO: 16)

35    ERVLQGLLKP LFKSTSVGPL YSGCRLTLLR PEKRGAATGV DTICTHRLDP   (SEQ ID NO: 17)
```

TABLE 3-continued

Amino Acid Sequence for a 400 bp Repeat in the CA125 Molecule
(SEQ ID NO: 11 thru SEQ ID NO: 21)

```
111 ERVLQGLLTP LFKNTSVGPL YSGCRLTLLR PEKQEAATGV DTICTHRVDP   (SEQ ID NO: 18)

42 ERVLQGLLKP LFKNTSVGPL YSGCRLTLLR PEKHEAATGV DTICTHRLDP   (SEQ ID NO: 19)

116 ERVLQGLLSP IFKMSSVGPL YSGCRLTSLR PEKDGAATGM DAVCLYHPNP   (SEQ ID NO: 20)

23 ERVLQGLLRP LFKNTSIGPL YSSCRLTLLR PEKDKAATRV DAICTHHPDP   (SEQ ID NO: 21)

51                                              100
 12 KSPRLDREQL YWELSQLTHN ITELGPYALD NDSLFVNGFT HRSSVSTTST

34 KSPGLDRERL YWKLSQLTHG ITELGPYTLD RHSLYVNGFT HQSSMTTTRT

32 KSPGLNREQL YWELSKLTND IEELGPYTLD RNSLYVNGFT HQSSVSTTST

46 KSPGLNREQL YWELSQLTHG IKELGPYTLD RNSLYVNGFT HRSSVAPTST

33 QSPGLDREQL YWQLSQMTNG IKELGPYTLD RNSLYVNGFT HRSSGLTTST

15 TGPGLDRERL YWELSQLTNS VTELGPYTLD RDSLYVNGFT HRSSVPTTSI

35 LNPGLDREQL YWELSKLTRG ITELGPYTLD RDSLYVNGFT HRSSVPTTSI

111 IGPGLDRERL YWELSQLTNS ITELGPYTLD RDSLYVDGFN PWSSVPTTST

42 LNPGLDREQL YWELSKLTRG IIELGPYLLD RGSLYVNGFT HRNFVPITST

116 KRPGLDREQL YWELSQLTHN ITELGPYSLD RDSLYVNGFT HQNSVPTTST

23 QSPGLNREQL YWELSQLTHG ITELGPYTLD RDSLYVNGFT HWSPIPTTST 101                                              150
 12 PGTPTVYLGA SKTPASIFGP S..AASPLLI PFT~~~~~~~ ~~~~~~~~~~

34 PDTSTMHLAT SRTPASLSGP T..TASPLLI PF~~~~~~~~ ~~~~~~~~~~

32 PGTSTVDLRT SGTPSSLSSP TIMAAGPLLI PF~~~~~~~~ ~~~~~~~~~~

46 PGTSTVDLGT SGTPSSLPSP T..TAVPLLI PF~~~~~~~~ ~~~~~~~~~~

33 PWTSTVDLGT SGTPSPVPSP T..TAGPFLI PF~~~~~~~~ ~~~~~~~~~~

15 PGTSAVHLET SGTPASLPGH T..APGPLLI PF~~~~~~~~ ~~~~~~~~~~

35 PGTSAVHLET SGTPASLPGH I..VPGPLLI PF~~~~~~~~ ~~~~~~~~~~

111 PGTSTVHLAT SGTPSPLPGH T..APVPLLI PFT~~~~~~~ ~~~~~~~~~~

42 PGTSTVHLGT SETPSSLPRP I..VPGPLLV PFT~~~~~~~ ~~~~~~~~~~

116 PGTSTVYWAT TGTPSSFPGH T..EPGPLLI PF'~~~~~~~ ~~~~~~~~~~

23 PGTSIVNLGT SGIPPSLPET T..ATGPLLI PFT~~~~~~~ ~~~~~~~~~~

151           170
 12 ~~~~~~~~~~ ~~~~~~~~~~

34 ~~~~~~~~~~ ~~~~~~~~~~

32 ~~~~~~~~~~ ~~~~~~~~~~

46 ~~~~~~~~~~ ~~~~~~~~~~

33 ~~~~~~~~~~ ~~~~~~~~~~

15 ~~~~~~~~~~ ~~~~~~~~~~

35 ~~~~~~~~~~ ~~~~~~~~~~

111 ~~~~~~~~~~ ~~~~~~~~~~

42 ~~~~~~~~~~ ~~~~~~~~~~

116 ~~~~~~~~~~ ~~~~~~~~~~

23 ~~~~~~~~~~ ~~~~~~~~~~
```

TABLE 4

Amino Acid Sequence for a 800 bp Repeat in the CA125 Molecule
(SEQ ID NO: 22 thru SEQ ID NO: 35)

```
      1                                                  50
 79 ERVLQGLLKP LFRNSSLEYL YSGCRLASLR PEKDSSAMAV DAICTHRPDP  (SEQ ID NO: 22)

811 ERVLQGLLKP LFRNSSLEYL YSGCRLASLR PEKDSSAMAV DAICTHRPDP  (SEQ ID NO: 23)

21 ERVLQGLLKP LFKSTSVGPL YSGCRLTLLR PEKRGAATGV DTICTHRLDP  (SEQ ID NO: 24)

89 ERVLQGLLKP LFKSTSVGPL YSGCRLTLLR PEKRGAATGV DTICTHRLDP  (SEQ ID NO: 25)

85 ERVLQGLLKP LFKSTSVGPL YSGCRLTLLR PEKRGAATGV DTICTHRLDP  (SEQ ID NO: 26)

712 ERVLQGLLKP LFKSTSVGPL YSGCRLTLLR PEKRGAATGV DTICTHRLDP  (SEQ ID NO: 27)

86 ERVLQGLLKP LFKSTSVGPL YSGCRLTLLR PEKHGAATGV DAICTLRLDP  (SEQ ID NO: 28)

87 ERVLQGLLTP LFKNTSVGPL YSGCRLTLLR PEKQEAATGV DTICTHRVDP  (SEQ ID NO: 29)

810 ERVLQGLLRP LFKNTSIGPL YSSCRLTLLR PEKDKAATRV DAICTHHPDP  (SEQ ID NO: 30)

83 ERVLQGLLRP VFKNTSVGPL YSGCRLTLLR PKKDGAATKV DAICTYRPDP  (SEQ ID NO: 31)

81 ERVLQGLLGP MFKNTSVGLL YSGCRLTLLR PKKDGAATKV DAICTYRPDP  (SEQ ID NO: 32)

44 ERVLQGLLKP LFKSTSVGPL YSGCRLTLLR PEKDGAATGM DAVCLYHPNP  (SEQ ID NO: 33)

812 ERVLQGLLSP ISKNSSVGPL YSGCRLTSLR PEKDGAATGM DAVCLYHPNP  (SEQ ID NO: 34)

76 ERVLQGLLSP IFKNSSVGSL YSGCRLTLLR PEKDGAATRV DAVCTHRPDP  (SEQ ID NO: 35)

51                                                 100
 79 EDLGLDRERL YWELSNLTNG IQELGPYTLD RNSLYVNGFT HRSSMPTTST

811 EDLGLDRERL YWELSNLTNG IQELGPYTLD RNSLYVNGFT HRSSGLTTST

21 LNPGLDREQL YWELSKLTRG IIELGPYLLD RGSLYVNGFT HRTSVPTTST

89 LNPGLDREQL YWELSKLTRG IIELGPYLLD RGSLYVNGFT HRNFVPITST

85 LNPGLDREQL YWELSKLTRG IIELGPYLLD RGSLYVNGFS RQSSMTTTRT

712 LNPGLDREQL YWELSKLTRG IIELGPYLLD RDSLYVNGFT HRSSVPTTSI

86 TGPGLDRERL YWELSQLTNS VTELGPYTLD RDSLYVNGFT HRSSVPTTSI

87 IGPGLDRERL YWELSQLTNS ITELGPYTLD RDSLYVNGFN PWSSVPTTST

810 QSPGLNREQL YWELSQLTHG ITELGPYTLD RDSLYVDGFT HWSPIPTTST

83 KSPGLDREQL YWELSQLTHS ITELGPYTLD RDSLYVNGFT QRSSVPTTSI

81 KSPGLDREQL YWELSQLTHS ITELGPYTLD RDSLYVNGFT QRSSVPTTSI

44 KRPGLDREQL YCELSQLTHD ITELGPYSLD RDSLYVNGFT HQNSVPTTST

812 KRPGLDREQL YWELSQLTHN ITELGPYSLD RDSLYVNGFT HQNSVPTTST

76 KSPGLDRERL YWKLSQLTHG ITELGPYTLD RHSLYVNGFT HQSSMTTTRT 101                                                 150
 79 PGTSTVDVGT SGTPSSSPSP TTAGPLLMPF TLNFTITNLQ YEEDMRRTGS

811 PWTSTVDLGT SGTPSPVPSP TTAGPLLIPF TLNFTITNLQ YEENMGHPGS

21 PGTSTVDLGT SGTPFSLPSP ATAGPLLVLF TLNFTITNLK YEEDMHRPGS

89 PGTSTVHLGT SETPSSLPRP IVPGPLLIPF TINFTITNLR YEENMHHPGS

85 PDTSTMHLAT SRTPASLSGP TTASPLLIPF TLNFTITNLQ YEENMGHPGS

712 PGTSAVHLET FGTPASLHGH TAPGPVLVPF TLNFTITNLQ YEEDMRHPGS

86 PGTSAVHLET SGTPASLPGH TAPGPLLVPF TLNFTITNLQ YEEDMRHPGS

87 PGTSTVHLAT SGTPSSLPGH TAPVPLLIPF TLNFTITNLH YEENMQHPGS

810 PGTSIVNLGT SGIPPSLPET TATGPLLIPF TPNFTITNLQ YEEDMRRTGS
```

TABLE 4-continued

Amino Acid Sequence for a 800 bp Repeat in the CA125 Molecule
(SEQ ID NO: 22 thru SEQ ID NO: 35)

```
 83 PGTPTVDLGT SGTPVSKPGP SAASPLLVPF TLNFTITNLQ YEEDMHRPGS

81 PGTPTVDLGT SGTPVSKPGP SAASPLLIPF TINFTITNLR YEENMGHPGS

44 PGTSTVYWAT TGTPSSFPGH TEPGPLLIPF TFNFTITNLH YEENMQHPGS

812 PGTSTVYWAT TGTPSSFPGH TEPGPLLIPF TVNFTITNLR YEENMHHPGS

76 PDTSTMHLAT SRTPASLSGP TTASPLLVLF TINFTITNQR YEENMHHPGS 151                                              200
 79 RKFNTMERVL QGLLSPIFKN SSVGPLYSGC RLTSLRPEKD GAATGMDAVC

811 RKFNIMERVL QGLLMPLFKN TSVSSLYSGC RLTLLRPEKD GAATRVDAVC

21 RKFNTTERVL QTLLGPMFKN TSVGLLYSGC RLTLLRSEKD GAATGVDAIC

89 RKFNIMERVL QGLLGPLFKN SSVGPLYSGC RLISLRSEKD GAATGVDAIC

85 RKFNIMERVL QGLLNPIFKN SSVGPLYSGC RLTSLKPEKD GAATGMDAVC

712 RKFNTTERVL QGLLKPLFKS TSVGPLYSGC RLTLLRPEKR GAATGVDTIC

86 RKFNTTERVL QGLLKPLFKS TSVGPLYSGC RLTLLRPEKR GAATGVDTIC

87 RKFNTTERVL QGLLKPLFKS TSVGPLYSGC RLTLLRPEKH GAATGVDAIC

810 RKFNTMERVL QGLLSPIFKN SSVGPLYSGC RLTSLRPEKD GAATGMDAVC

83 RKFNATERVL QGLLSPIFKN SSVGPLYSGC RLTSLRPEKD GAATGMDAVC

81 RKFNIMERVL QGLLKPLFKN TSVGPLYSGC RLTLLRPKKD GAATGVDAIC

44 RKFNTTERVL QGLLKPLFKN TSVGPLYSGC RLTLLRPEKH EAATGVDTIC

812 RKFNTTERVL QGLLRPVFKN TSVGPLYSGC RLTLLRPKKD GAATKVDAIC

76 RKFNTTERVL QGLLRPVFKN TSVGPLYSGC RLTLLRPKKD GAATKVDAIC 201                                              250
 79 LYHPNPKRPG LDREQLYWEL SQLTHNITEL GPYSLDRDSL YVNGFTHQNS

811 TQRPDPKSPG LDRERLYWKL SQLTHGITEL GPYTLDRHSL YVNGLTHQSS

21 THRLDPKSPG VDREQLYWEL SQLTNGIKEL GPYTLDRNSL YVNGFTHWIP

89 THHLNPQSPG LDREQLYWQL SQMTNGIKEL GPYTLDRNSL YVNGFTHRSS

85 LYHPNPKRPG LDREQLYWEL SQLTHGIKEL GPYTLDRNSL YVNGFTHRSS

712 THRLDPLNPG LDREQLYWEL SKLTRGIIEL GPYLLDRGSL YVNGFTHRNF

86 THRLDPLNPG LDREQLYWEL SKLTRGIIEL GPYLLDRGSL YVNGFTHRNF

87 THRLDPKSPG VDREQLYWEL SQLTNGIKEL GPYTLDRNSL YVNGFTHWIP

810 LYHPNPKRPG LDREQLY~~~ ~~~~~~~~~~ ~~~~~~~~~~ ~~~~~~~~~~

83 LYHPNPKRPG LDREQLYWEL SQLTHNITEL GPYSLDRDSL YVNGFTHQSS

81 THRLDPKSPG LNREQLYWEL SKLTNDIEEL GPYTLDRNSL YVNGFTHQSS

44 THRVDPIGPG LDRERLYWEL SQLTNSIHEL GPYTLDRDSL YVNGFNPRSS

812 TYRPDPKSPG LDREQLYWEL SKLTNDIEEL GPYTLDRNSL YVNGFTHQSS

76 TYRPDPKSPG LDREQLYWEL SQLTHSITEL GPYTQDRDSL YVNGFTHRSS 251                         288
 79 VPTTSTPGTS TVYWATTGTP SSFPGHT..E PGPL~~~~

811 MTTTRTPDTS TMHLATSRTP ASLSGPT..T ASPLLIPF

21 ~~~~~~~~~~ ~~~~~~~~~~ ~~~~~~~~~~ ~~~~~~~~

89 GLTTSTPWTS TVDLGTSGTP SPVPSPT..T AGPLLIPF
```

TABLE 4-continued

Amino Acid Sequence for a 800 bp Repeat in the CA125 Molecule
(SEQ ID NO: 22 thru SEQ ID NO: 35)

```
 85 VAPTSTPGTS TVDLGTSGTP SSLPSPT..T AVPLLIPF

712 VPITSTPGTS TVHLGTSETP SSLPRPI..V PGPLLIPF

86 VPITSTPGTS TVHLGTSETP SSLPRPI..V PGPLLIPF

87 VPTSSTPGTS TVDLG.SGTP SSLPSPT..T AGPL~~~~

810 ~~~~~~~~~~ ~~~~~~~~~~ ~~~~~~~~~~ ~~~~~~~~

83 MTTTRTPDTS TMHLATSRTP ASLSGPT..T ASPLLIPF

81 VSTTSTPGTS TVDLRTSGTP SSLSSPTIMA AGPLLIPF

44 VPTTSTPGTS TVHLATSGTP SSLPGHT..A PVPLLI~~

812 VSTTSTPGTS TVDLRTSGTP SSLSSPTIMA AGPLLIPF

76 VPTTSIPGTS AVHLETSGTP ASLP~~~~~ ~~~~~~~~
```

TABLE 5

Amino Acid Sequence for a 1200 bp Repeat in the CA125 Molecule
(SEQ ID NO: 36 thru SEQ ID NO: 46)

```
              1                                                50
910  ERVLQGLLGP MFKNTSVGLL YSGCRLTLLR PEKRGAATGV DTICTHRLDP   (SEQ ID NO: 36)

99  ERVLHGLLTP LFKNTRVGPL YSGCRLTLLR PEKQEAATGV DTICTHRVDP   (SEQ ID NO: 37)

112  ~~~~~~~~~~ ~~~~~~~GPL YSGCRLTSLR PEKDGAATGM DAVCLYHPNP   (SEQ ID NO: 38)

95  ERVLQGPLSP IFKNSSVGPL YSGCRLTSLR PEKDGAATGM DAVCLYHPNP   (SEQ ID NO: 39)

71  ~~~~~~~~~~ ~~~~TSVGPL YSGCRLTLLR SEKDGAATGV DAIYTHRLDP   (SEQ ID NO: 40)

78  ~~~~~~~~~~ ~~~~~~~~~~ ~~~~~~TLLR PKKDGVATGV DAICTHRLDP   (SEQ ID NO: 41)

115  ERVLQGLLKP LFKSTSVGPL YSGCRLTLLR PEKDGVATRV DAICTHRPDP   (SEQ ID NO: 42)

91  ERVLQGLLKP LFRNSSLEYL YSGCRLASLR PEKDSSAMAV DAICTHRPDP   (SEQ ID NO: 43)

92  ERVLQGLLKP LFKSTSVGPL YSGCRLTLLR PEKRGAATGV DTICTHRLDP   (SEQ ID NO: 44)

113  ERVLQGLLGP MFKNTSVGLL YSGCRLTLLR PEKNGAATGM DAICSHRLDP   (SEQ ID NO: 45)

711  ERVLQGLLKP LFKSTSVGPL YSGCRLTLLR PEKHGAATGV DAICTLRLDP   (SEQ ID NO: 46)

51                                               100
910  LNPGLDREQL YWELSKLTRG IIELGPYLLD RGSLYVNGFT HRNFVPITST

99  IGPGLDRERL YWELSQLTNS ITELGPYTLD RDSLYVNGFN PWSSVPTTST

112  KRPGLDREQL YWELSQLTHN ITELGPYSLD RDSLYVNGFT HQNSVPTTST

95  KRPGLDREQL YWELSQLTHN ITELGPYSLD RDSLYVNGFT HQNSVPTTST

71  KSPGVDREQL YWELSQLTNG IKELGPYTLD RNSLYVNGFT HQTSAPNTST

78  KSPGLNREQL YWELSKLTND IEELGPYTLD RNSLYVNGFT HQSSVSTTST

115  KIPGLDRQQL YWELSQLTHS ITELGPYTLD RDSLYVNGFT QRSSVPTTST

91  EDLGLDRERL YWELSNLTNG IQELGPYTLD RNSLYVNGFT HRSSMPTTST

92  LNPGLDREQL YWELSKLTRG IIELGPYLLD RGSLYVNGFT HRNFVPITST

113  KSPGLNREQL YWELSQLTHG IKELGPYTLD RNSLYVNGFT HRSSVAPTST

711  TGPGLDRERL YWELSQLTNS VTELGPYTLD RDSLYVNGFT HRSSVPTTSI 101                                              150
910  PGTSTVHLGT SETPSSLPRP IV..PGPLLV PFTLNFTITN LQYEEAMRHP
```

TABLE 5-continued

Amino Acid Sequence for a 1200 bp Repeat in the CA125 Molecule
(SEQ ID NO: 36 thru SEQ ID NO: 46)

```
 99 PGTSTVHLAT SGTPSSLPGH TA..PVPLLI PFTLNFTITN LHYEENMQHP

112 PGTSTVYWAT TGTPSSFPGH T..EPGPLLI PFTLNFTITN LQYEENMGHP

95 PGTSTVYWAT TGTPSSFPGH T..EPGPLLI PFTLNFTITN LQYEENMGHP

71 PGTSTVDLGT SGTPSSLPSP T..SAGPLLI PFTINFTITN LRYEENMHHP

78 PGTSTVDLRT SGTPSSLSSP TIMAAGPLLI PFTINFTITN LRYEENMHHP

115 PGTFTVQPET SETPSSLPGP T..ATGPVLL PFTLNFTIIN LQYEEDMHRP

91 PGTSTVDVGT SGTPSSSPSP T..TAGPLLM PFTLNFTITN LQYEEDMRRT

92 PGTSTVHLGT SETPSSLPRP IV..PGPLLI PFTLNFTITN LQYEENMGHP

113 PGTSTVDLGT SGTPSSLPSP T..TAVPLLI PFTLNFTITN LKYEEDMHCP

711 PGTSAVHLET SGTPASLPGH T..APGPLLI PFTLNFTITN LHYEENMQHP
       151                                                200
910 GSRKFNTTER VLQGLLRPLF KNTSVSSLYS GCRLTLLRPE KDGAATRVDA

99 GSRKFNTTER VLQGLLKPLF KNTSVGPLYS GCRLTLFKPE KHEAATGVDA

112 GSRKFNITES VLQGLLTPLF KNSSVGPLYS GCRLISLRSE KDGAATGVDA

95 GSRKFNITER VLQGLLNPIF KNSSVGPLYS GCRLTSLRPE KDGAATGMDA

71 GSRKFNTMER VLQGLLKPLF KSTSVGPLYS GCRLTLLRPE KDGVATRVDA

78 GSRKFNTMER VLQGLLMPLF KNTSVSSLYS GCRLTLLRPE KDGAATRVDA

115 GSRKFNTTER VLQGLLMPLF KNTSVGPLYS GCRLTLLRPE KQEAATGVDT

91 GSRKFNTMES VLQGLLKPLF KNTSVGPLYS GCRLTLLRPK KDGAATGVDA

92 GSRKFNITER VLQGLLKPLF RNSSLEYLYS GCRLTSLRPE KDSSTMAVDA

113 GSRKFNTTER VLQSLFGPMF KNTSVGPLYS GCRLTLFRSE KDGAATGVDA

711 GSRKFNTMER VLQGCLVPCS RNTNVGLLYS GCRLTLLXXX XXXXXXXXXX
       201                                                250
910 ACTYRPDPKS PGLDREQLYW ELSQLTHSIT ELGPYTLDRV SLYVNGFNPR

99 ICTLRLDPTG PGLDRERLYW ELSQLTNSVT ELGPYTLDRD SLYVNGFTHR

112 ICTHHLNPQS PGLDREQLYW QLSQMTNGIK ELGPYTLDRD SLYVNGFTHR

95 VCLYHPNPKR PGLDREQLYC ELSQLTHNIT ELGPYSLDRD SLYVNGFTHQ

71 ICTHRPDPKI PGLDRQQLYW ELSQLTHSIT ELGPYTLDRD SLYVNGFTQR

78 VCTHRPDPKS PGLDRERLYW KLSQLTHGIT ELGPYTLDRN SLYVNGFTHR

115 ICTHRLDPSE PGLDREQLYW ELSQLTNSIT ELGPYTLDRD SLYVNGFTHS

91 ICTHRLDPKS PGLNREQLYW ELSKLTNDIE EVGPYTLDRN SLYVNGFTHR

92 ICTHRPDPED LGLDRERLYW ELSNLTNGIQ ELGPYTLDRN SLYVNGFTHR

113 ICTHRLDPKS PGVDREQLYW ELSQLTNGIK ELGPYTLDRN SLYVNGFTHQ

711 XXXXXXXXXX XXXXXXXXXX XXXXXXXXXX XXGPYTLDRN SLYVNGFTHR
       251                                                300
910 SSV.PTTSTP GTSTVHLATS GTPSSLPGHT APVPLLIPFT LNFTITNLQY

99 SSV.PTTSIP GTSAVHLETS GTPASLPGHT APGPLLIPFT LNFTITNLQY

112 SL.GLTTSTP WTSTVDLGTS GTPSPVPSPT TAGPLLIPFT LNFTITNLQY

95 NS.VPTTSTP GTSTVYWATT GTPSSFPGHT EPGPLLIPFT LNFTITNLQY

71 SSV.PTTSTP GTFTVQPETS ETPSSLPGPT ATGPVLLPFT LNFTIINLQY
```

TABLE 5-continued

Amino Acid Sequence for a 1200 bp Repeat in the CA125 Molecule
(SEQ ID NO: 36 thru SEQ ID NO: 46)

```
 78 SSM.PTTSTP GTSTVDVGTS GTPSSSPSPT TAGPLLMPFT LNFTITNLQY

115 GVLCP45

PPSIL GIFTVQPETF ETPSSLPGPT ATGPVLLPFT LNFTIINLQY

91 SFVAP.TSTL GTSTVDLGTS GTPSSLPSPT TGVPLLIPFT LNFTITNLQY

92 SFM.PTTSTL GTSTVDVGTS GTPSSSPSPT TAGPLLMPFT LNFTITNLQY

113 TS.APNTSTP GTSTVDLGTS GTPSSLPSPT SAGPLLVPFT LNFTITNLQY

711 SSVAP.TSTP GTSTVDLGTS GTPSSLPSPT TV.PLLVPFT LNFTITNLQY 301                                                350
910 EEDMRHPGSR KFNTMERVLQ GLLRPLFKNT SIGPLYSSCR LTLLRPEKDK

99 EEDMRRTGSR KFNTMERVLQ GLLKPLFKST SVGPLYSGCR LTLLRPEKRG

112 EENMGHPGSR KFNIMERVLQ GLLRPVFKNT SVGPLYSGCR LTLLRPKKDG

95 EEDMRRTGSR KFNTMERVLQ GLLKPLFKST SVGPLYSGCR LTLLRPEKHG

71 EEDMHRPGSR KFNTTERVLQ GLLKPLFKST SVGPLYSGCR LTLLRPEKHG

78 EEDMRRTGSR KFNTMERVLQ GLLKPLFKST SVGPLYSGCR LTLLRPEKHG

115 EEDMHRPGSR KFNTTERVLQ GLLMPLFKNT SVGPLYSGCR LTLLRPEKQE

91 EENMGHPGSR KFNIMERVLQ GLLMPLFKNT SVSSLYSGCR LTLLRPEKDG

92 EEDMRRTGSR KFNTMESVLQ GLLKPLFKNT SVGPLYSGCR LTLLRPKKDG

113 EEDMRRTGSR KFNTMESVLQ GLLKPLFKNT SVGPLYSGCR LTLLRPEKDG

711 GEDMRHPGSR KFNTTERVLQ GLLGPLFKNS SVGPLYSGCR LISLRSEKDG 351                                                400
910 AATRVDAICT HHPDPQSPGL NREQLYWELS QLTHGITEL~ ~~~~~~~~~~

99 AATGVDTICT HRLDPLNPGL DREQLYWELS KLTRGIIELG PYLLDRGSLY

112 AATKVDAICT YRPDPKSPGL DREQLYWELS QLTHSITELG PYTLDRDSLY

95 AATGVDAICT LRLDPTGPGL DRERLYWELS QLTNSVTELG PYTLDRDSLY

71 AATGVDAICT LRLDPTGPGL DRERLYWELS QLTNSITELG PYTLDRDSLY

78 AATGVDAICT LRLDPTGPGL DRERLYWELS QLTNSVTELG PYTLDRDSLY

115 AATGVDTICT HRVDPIGPGL DRERLYWELS QLTNSITELG PYTLDRDSLY

91 AATRVVAVCT HRPDPKSPGL DRERLYWKLS QLTHGITELG PYTLDRHSLY

92 AATGVDAICT HRLDPKSPGL NREQLYWELS KLTNDIEELG PYTLDRNSLY

113 AATGVDAICT HRLDPKSPGL NREQLYWELS KL~~~~~~~~ ~~~~~~~~~~

711 AATGVDAICT HHLNPQSPGL DREQLYWQLS QVTNGIKELG PYTLDRNSLY 401                                       447
910 ~~~~~~~~~~ ~~~~~~~~~~ ~~~~~~~~~~ ~~~~~~~~~~ ~~~~~~~

99 VNGFTHRNFV PITSTPGTST VHLGTSEIHP SLPRPI..VP GPL~~~~

112 VNGFTQRSSV PTTSIPGTPT VDLGTSGTPV SKPGPS..AA SP~~~~~

95 VNGFTHRSSV PTTSIPGTSA VHLETSGTPA SLPGHT..AP GPLL~~~

71 VNGFNPWSSV PTTSTPGTST VHLATSGTPS SLPGHT..AP VPL~~~~

78 VNGFTHRSSV PTTSIPGTSA VHLETSGTPA SLPGHT..AP GPLLIPF

115 VNGFNPWSSV PTTSTPGTST VHLATSGTPS SLPGHT..AP VPLLIPF

91 VNGFTHQSSM TTTRTPDTST MHLATSRTPA SLSGPT..TA SPLLIPF
```

TABLE 5-continued

Amino Acid Sequence for a 1200 bp Repeat in the CA125 Molecule
(SEQ ID NO: 36 thru SEQ ID NO: 46)

```
 92  VNGFTHQSSV STTSTPGTST VDPRTSGTPS SLSSPTIMAA GPLLI~~
113  ~~~~~~~~~~ ~~~~~~~~~~ ~~~~~~~~~~ ~~~~~~~~~~ ~~~~~~~
711  VNGFTHRSSG LTTSTPWTST VDLGTSGTPS PVPSPT..TA GPLLI~~
```

TABLE 6

Amino Acid Sequence for a 9 Repeat Structure in the CA125 Molecule
(SEQ ID NO: 47)

```
ERVLQGLLKP LFRNSSLEYL YSG|CRLASLR PEKDSSAMAV DAIC|THRPDP
EDLGLDRERL YWELSNLTNG IQELGPYTLD RNSLYVNGFT HRSSMPTTST
PGTSTVDVGT SGTPSSSPSP TTAGPLLMPF TLNFTITNLQ YEEDMRRTGS
RKFNTMERVL QGPLSPIFKN SSVGPLYSG|C RLTSLRPEKD GAATGM DAV
C|LYHPNPKRP GLDREQLYWE LSQLTHNITE LGPYSLDRDS LYVNGFTHQN
SVPTTSTPGT STVYWATTGT PSSFPGHTEP GPLLIPFTLN FTITNLQYEE
NMGHPGSRKF NITERVLQGL LNPIFKNSSV GPLYSG|CRLT SLRPEKDGAA
TGMDAVC|LYH PNPKRPGLDR EQLYCELSQL THNITELGPY SLDRDSLYVN
GFTHQNSVPT TSTPGTSTVY WATTGTPSSF PGHTEPGPLL IPFTLNFTIT
NLQYEEDMRR TGSRKFNTME RVLQGLLKPL FKSTSVGPLY SG|CRLTLLRP
EKHGAATGVD AIC|TLRLDPT GPGLDRERLY WELSQLTNSV TELGPYTLDR
DSLYVNGFTH RSSVPTTSIP GTSAVHLETS GTPASLPGHT APGPLLVPFT
LNFTITNLQY EEDMRHPGSR KFNTTERVLQ GLLKPLFKST SVGPLYSG|CR
LTLLRPEKRG AATGVDTIC|T HRLDPLNPGL DREQLYWELS KLTRGIIELG
PYLLDRGSLY VNGFTHRNFV PITSTPGTST VHLGTSETPS SLPRPIVPGP
LLIPFTLNFT ITNLQYEENM GHPGSRKFNI TERVLQGLLK PLFRNSSLEY
LYSG|CRLASL RPEKDSSAMA VDAIC|THRPD PEDLGLDRER LYWELSNLTN
GIQELGPYTL DRNSLYVNGF THRSSMPTTS TPGTSTVDVQ TSGTPSSSPS
PTTAGPLLMP FTLNFTITNL QYEEDMRRTG SRKFNTMESV LQGLLKPLFK
NTSVGPLYSG |CRLTLLRPKK DGAATGVDAI C|THRLDPKSP GLNREQLYWE
LSKLTNDIEE VGPYTLDRNS LYVNGFTHRS FVAPTSTLGT STVDLGTSGT
PSSLPSPTTG VPLLIPFTLN FTITNLQYEE NMGHPGSRKF NIMERVLQGL
LSPIFKNSSV GSLYSG|CRLT LLRPEKDGAA TRVDAVC|THR PDPKSPGLDR
ERLYWKLSQL THGIIELGPY TLDRHSFYVN GFTHQSSMTT TRTPDSTMH
LATSRTPASL SGPTTASPLL VLFTINFTIT NQRYEENMHH PGSRKFNTTE
RVLQGLLRPV FKNTSVGPLY SGCR|LTLLRP KKDGAATKVD AICTYRP|DPK
```

TABLE 6-continued

Amino Acid Sequence for a 9 Repeat Structure in
the CA125 Molecule
(SEQ ID NO: 47)

SPGLDREQLY WELSQLTHSI TELGPYTQDR DSLYVNGFTH RSSVPTTSIP

GTSAVHLETS GTPASLP

TABLE 7 cDNA Genbank Accession # AK024365 Encompasses Repeat Sequences
(Repeats 1 & 2) Homologous to Two Repeats Shown in Table 6
(SEQ ID NO: 48)

MPLFKNTSVS SLYSG`CRLTL LRPEKDGAAT RVDAVC`THRP DPKSPGLDRE

RLYWKLSQLT HGIIELGPYT LDRHSFYVNG FTHQSSMTTT RTPDTSTMHL

ATSRTPASLS GPTTASPLLV LFTINFTITN QRYEENMHHP GSRKFNTTER

VLQGLLRPVF KNTSVGPLYS G`CRLTLLRPK KDGAATKVDA IC`TYRPDPKS

PGLDREQLYW ELSQLTHSIT ELGPYTQDRD SLYVNGFTHR SSVPTTSIPG

TSAVHLETSG TPASLPGPSA ASPLLVLFTL NFTITNLRYE ENMQHPGSRK

FNTTERVLQG LLRSLFKSTS VGPLYSG`CRL TLLRPEKDGT ATGVDAIC`TH

HPDPKSPRLD REQLYWELSQ LTHNITELGH YALDNDSLFV NGFTHRSSVS

TTSTPGTPTV YLGASKTPAS IFGPSAASHL LILFTLNFTI TNLRYEENMW

PGSRKFNTTE RVLQGLLRPL FKNTSVGPLY SG`SRLTLLRP EKDGEATGVD

AIC`THRPDPT GPGLDREQLY LELSQLTHSI TELGPYTLDR DSLYVNGFTH

RSSVPTTSTG VVSEEPFTLN FTINNLRYMA DMGQPGSLKF NITDNVMKHL

LSPLFQRSSL GARYTG`CRVI ALRSVKNGAE TRVDLLC`TYL QPLSGPGLPI

KQVFHELSOQ THGITRLGPY SLDKDSLYLN GYNEPGLDEP PTTPKPATTF

LPPLSEATTA MGYHLKTLTL NFTISNLQYS PDMGKGSATF NSTEGVLQHL

LRPLFQKSSM GPFYLG`CQLI SLRPEKDGAA TGVDTTC`TYH PDPVGPGLDI

QQLYWELSQL THGVTQLGFY VLDRDSLFIN GYAPQNLSIR GEYQINFHIV

VLVTVKALFS SNLDPSLVEQ VFLDKTLNAS FHWLGSTYQL VDIHVTEMES

SVYQPTSSSS TQHFYLNFTI TNLPYSQDKA QPGTTNYQRN KRNIEDALNQ

LFRNSSIKSY FSDCQVSTFR SVPNRHHTGV DSLCNFSPLA RRVDRVAIYE

EFLRMTRNGT QLQNFTLDRS SVLVDGYSPN RNEPLTGNSD LPFWAVILIG

LAGLLGLITC LICGVLVTTR RRKKEGEYNV QQQCPGYYOS HLDLEDLQ

TABLE 8

Complete DNA Sequence for 13 Repeats including the Carboxy
Terminus of CA125(SEQ ID NO: 49)

1   GAGAGGGTTC TGCAGGGTCT GCTCAAACCC TTGTTCAGGA ATAGCAGTCT

51  GGAATACCTC TATTCAGGCT GCAGACTAGC CTCACTCAGG CCAGAGAAGG

TABLE 8-continued

Complete DNA Sequence for 13 Repeats including the Carboxy Terminus of CA125(SEQ ID NO: 49)

```
 101 ATAGCTCAGC CATGGCAGTG GATGCCATCT GCACACATCG CCCTGACCCT
 151 GAAGACCTCG GACTGGACAG AGAGCGACTG TACTGGGAGC TGAGCAATCT
 201 GACAAATGGC ATCCAGGAGC TGGGCCCCTA CACCCTGGAC CGGAACAGTC
 251 TCTATGTCAA TGGTTTCACC CATCGAAGCT CTATGCCCAC CACCAGCACT
 301 CCTGGGACCT CCACAGTGGA TGTGGGAACC TCAGGGACTC CATCCTCCAG
 351 CCCCAGCCCC ACGACTGCTG GCCCTCTCCT GATGCCGTTC ACCCTCAACT
 401 TCACCATCAC CAACCTGCAG TACGAGGAGG ACATGCGTCG CACTGGCTCC
 451 AGGAAGTTCA ACACCATGGA GAGGGTTCTG CAGGGTCCGC TTAGTCCCAT
 501 ATTCAAGAAC TCCAGTGTTG CCCTCTGTA CTCTGGCTGC AGACTGACCT
 551 CTCTCAGGCC CGAGAAGGAT GGGGCAGCAA CTGGAATGGA TGCTGTCTGC
 601 CTCTACCACC CTAATCCCAA AGACCTGGG CTGGACAGAG AGCAGCTGTA
 651 CTGGGAGCTA AGCCAGCTGA CCCACAACAT CACTGAGCTG GGCCCCTACA
 701 GCCTGGACAG GGACAGTCTC TATGTCAATG GTTTCACCCA TCAGAACTCT
 751 GTGCCCACCA CCAGTACTCC TGGGACCTCC ACAGTGTACT GGGCAACCAC
 801 TGGGACTCCA TCCTCCTTCC CCGGCCACAC AGAGCCTGGC CCTCTCCTGA
 851 TACCATTCAC GCTCAACTTC ACCATCACTA ACCTACAGTA TGAGGAGAAC
 901 ATGGGTCACC CTGGCTCCAG GAAGTTCAAC ATCACGGAGA GGGTTCTGCA
 951 GGGTCTGCTT AATCCCATTT CAAGAACTC CAGTGTTGGC CCTCTGTACT
1001 CTGGCTGCAG ACTGACCTCT CTCAGGCCCG AGAAGGATGG GGCAGCAACT
1051 GGAATGGATG CTGTCTGCCT CTACCACCCT AATCCCAAAA GACCTGGGCT
1101 GGACAGAGAG CAGCTGTACT GCGAGCTAAG CCAGCTGACC CACAACATCA
1151 CTGAGCTGGG CCCCTACAGC TTGGACAGGG ACAGTCTTTA TGTCAATGGT
1201 TTCACCCATC AGAACTCTGT GCCCACCACC AGTACTCCTG GGACCTCCAC
1251 AGTGTACTGG GCAACCACTG GGACTCCATC CTCCTTCCCC GGCCACACAG
1301 AGCCTGGCCC TCTCCTGATA CCATTCACCC TCAACTTCAC CATCACCAAC
1351 CTGCAGTACG AGGAGGACAT GCGTCGCACT GGCTCCAGGA AGTTCAACAC
1401 CATGGAGAGG GTTCTGCAGG GTCTGCTCAA GCCCTTGTTC AAGAGCACCA
1451 GCGTTGGCCC TCTGTACTCT GGCTGCAGAC TGACCTTGCT CAGACCTGAG
1501 AAACATGGGG CAGCCACTGG AGTGGACGCC ATCTGCACCC TCCGCCTTGA
1551 TCCCACTGGT CCTGGACTGG ACAGAGAGCG CTATACTGG GAGCTGAGCC
1601 AGCTGACCAA CAGCGTTACA GAGCTGGGCC CCTACACCCT GGACAGGGAC
1651 AGTCTCTATG TCAATGGCTT CACCCATCGG AGCTCTGTGC AACCACCAG
1701 TATTCCTGGG ACCTCTGCAG TGCACCTGGA AACCTCTGGG ACTCCAGCCT
1751 CCCTCCCTGG CCACACAGCC CCTGGCCCTC TCCTGGTGCC ATTCACCCTC
1801 AACTTCACTA TCACCAACCT GCAGTATGAG GAGGACATGC GTCACCCTGG
1851 TTCCAGGAAG TTCAACACCA CGGAGAGAGT CCTGCAGGGT CTGCTCAAGC
1901 CCTTGTTCAA GAGCACCAGT GTTGGCCCTC TGTACTCTGG CTGCAGACTG
1951 ACCTTGCTCA GGCCTGAAAA ACGTGGGGCA GCCACCGGCG TGGACACCAT
```

TABLE 8-continued

Complete DNA Sequence for 13 Repeats including the Carboxy Terminus of CA125(SEQ ID NO: 49)

```
2001 CTGCACTCAC CGCCTTGACC CTCTAAACCC TGGACTGGAC AGAGAGCAGC
2051 TATACTGGGA GCTGAGCAAA CTGACCCGTG GCATCATCGA GCTGGGCCCC
2101 TACCTCCTGG ACAGAGGCAG TCTCTATGTC AATGGTTTCA CCCATCGGAA
2151 CTTTGTGCCC ATCACCAGCA CTCCTGGGAC CTCCACAGTA CACCTAGGAA
2201 CCTCTGAAAC TCCATCCTCC CTACCTAGAC CCATAGTGCC TGGCCCTCTC
2251 CTGATACCAT TCACACTCAA CTTCACCATC ACTAACCTAC AGTATGAGGA
2301 GAACATGGGT CACCCTGGCT CCAGGAAGTT CAACATCACG GAGAGGGTTC
2351 TGCAGGGTCT GCTCAAACCC TTGTTCAGGA ATAGCAGTCT GGAATACCTC
2401 TATTCAGGCT GCAGACTAAC CTCACTCAGG CCAGAGAAGG ATAGCTCAAC
2451 CATGGCAGTG GATGCCATCT GCACACATCG CCCTGACCCT GAAGACCTCG
2501 GACTGGACAG AGAGCGACTG TACTGGGAGC TGAGCAATCT GACAAATGGC
2551 ATCCAGGAGC TGGGCCCCTA CACCCTGGAC CGGAACAGTC TCTATGTCAA
2601 TGGTTTCACC CATCGAAGCT CTATGCCCAC CACCAGCACT CCTGGGACCT
2651 CCACAGTGGA TGTGGGAACC TCAGGGACTC CATCCTCCAG CCCCAGCCCC
2701 ACGACTGCTG GCCCTCTCCT GATGCCGTTC ACCCTCAACT TCACCATCAC
2751 CAACCTGCAG TACGAGGAGG ACATGCGTCG CACTGGCTCC AGGAAGTTCA
2801 ACACCATGGA GAGTGTCCTG CAGGGTCTGC TCAAGCCCTT GTTCAAGAAC
2851 ACCAGTGTTG GCCCTCTGTA CTCTGGCTGC AGATTGACCT TGCTCAGGCC
2901 CAAGAAAGAT GGGGCAGCCA CTGGAGTGGA TGCCATCTGC ACCCACCGCC
2951 TTGACCCCAA AAGCCCTGGA CTCAACAGGG AGCAGCTGTA CTGGGAGTTA
3001 AGCAAACTGA CCAATGACAT TGAAGAGGTG GGCCCCTACA CCTTGGACAG
3051 GAACAGTCTC TATGTCAATG GTTTCACCCA TCGGAGCTTT GTGGCCCCCA
3101 CCAGCACTCT TGGGACCTCC ACAGTGGACC TTGGGACCTC AGGGACTCCA
3151 TCCTCCCTCC CCAGCCCCAC AACAGGTGTT CCTCTCCTGA TACCATTCAC
3201 ACTCAACTTC ACCATCACTA ACCTACAGTA TGAGGAGAAC ATGGGTCACC
3251 CTGGCTCCAG GAAGTTCAAC ATCATGGAGA GGGTTCTGCA GGGTCTGCTT
3301 ATGCCCTTGT TCAAGAACAC CAGTGTCAGC TCTCTGTACT CTGGTTGCAG
3351 ACTGACCTTG CTCAGGCCTG AGAAGGATGG GGCAGCCACC AGAGTGGTTG
3401 CTGTCTGCAC CCATCGTCCT GACCCCAAAA GCCCTGGACT GGACAGAGAG
3451 CGGCTGTACT GGAAGCTGAG CCAGCTGACC CACGGCATCA CTGAGCTGGG
3501 CCCCTACACC CTGGACAGGC ACAGTCTCTA TGTCAATGGT TTCACCCATC
3551 AGAGCTCTAT GACGACCACC AGAACTCCTG ATACCTCCAC AATGCACCTG
3601 GCAACCTCGA GAACTCCAGC CTCCCTGTCT GGACCTACGA CCGCCAGCCC
3651 TCTCCTGATA CCATTCACAA TTAACTTCAC CATCACTAAC CTGCGGTATG
3701 AGGAGAACAT GCATCACCCT GGCTCTAGAA AGTTTAACAC CACGGAGAGA
3751 GTCCTTCAGG GTCTGCTCAG GCCTGTGTTC AAGAACACCA GTGTTGGCCC
3801 TCTGTACTCT GGCTGCAGAC TGACCTTGCT CAGGCCCAAG AAGGATGGGG
3851 CAGCCACCAA AGTGGATGCC ATCTGCACCT ACCGCCCTGA TCCCAAAAGC
3901 CCTGGACTGG ACAGAGAGCA GCTATACTGG GAGCTGAGCC AGCTAACCCA
```

TABLE 8-continued

Complete DNA Sequence for 13 Repeats including the Carboxy
Terminus of CA125(SEQ ID NO: 49)

```
3951 CAGCATCACT GAGCTGGGCC CCTACACCCT GGACAGGGAC AGTCTCTATG
4001 TCAATGGTTT CACACAGCGG AGCTCTGTGC CCACCACTAG CATTCCTGGG
4051 ACCCCCACAG TGGACCTGGG AACATCTGGG ACTCCAGTTT CTAAACCTGG
4101 TCCCTCGGCT GCCAGCCCTC TCCTGGTGCT ATTCACTCTC AACTTCACCA
4151 TCACCAACCT GCGGTATGAG GAGAACATGC AGCACCCTGG CTCCAGGAAG
4201 TTCAACACCA CGGAGAGGGT CCTTCAGGGC CTGCTCAGGT CCCTGTTCAA
4251 GAGCACCAGT GTTGGCCCTC TGTACTCTGG CTGCAGACTG ACTTTGCTCA
4301 GGCCTGAAAA GGATGGGACA GCCACTGGAG TGGATGCCAT CTGCACCCAC
4351 CACCCTGACC CCAAAAGCCC TAGGCTGGAC AGAGAGCAGC TGTATTGGGA
4401 GCTGAGCCAG CTGACCCACA ATATCACTGA GCTGGGCCAC TATGCCCTGG
4451 ACAACGACAG CCTCTTTGTC AATGGTTTCA CTCATCGGAG CTCTGTGTCC
4501 ACCACCAGCA CTCCTGGGAC CCCCACAGTG TATCTGGGAG CATCTAAGAC
4551 TCCAGCCTCG ATATTTGGCC CTTCAGCTGC CAGCCATCTC CTGATACTAT
4601 TCACCCTCAA CTTCACCATC ACTAACCTGC GGTATGAGGA GAACATGTGG
4651 CCTGGCTCCA GGAAGTTCAA CACTACAGAG AGGGTCCTTC AGGGCCTGCT
4701 AAGGCCCTTG TTCAAGAACA CCAGTGTTGG CCCTCTGTAC TCTGGCTCCA
4751 GGCTGACCTT GCTCAGGCCA GAGAAAGATG GGGAAGCCAC CGGAGTGGAT
4801 GCCATCTGCA CCCACCGCCC TGACCCCACA GGCCCTGGGC TGGACAGAGA
4851 GCAGCTGTAT TTGGAGCTGA GCCAGCTGAC CCACAGCATC ACTGAGCTGG
4901 GCCCTACAC ACTGGACAGG GACAGTCTCT ATGTCAATGG TTTCACCCAT
4951 CGGAGCTCTG TACCCACCAC CAGCACCGGG GTGGTCAGCG AGGAGCCATT
5001 CACACTGAAC TTCACCATCA CAACCTGCG CTACATGGCC GACATGGGCC
5051 AACCCGGCTC CCTCAAGTTC AACATCACAG ACAACGTCAT GAAGCACCTG
5101 CTCAGTCCTT TGTTCCAGAG GAGCAGCCTG GGTGCACGGT ACACAGGCTG
5151 CAGGGTCATC GCACTAAGGT CTGTGAAGAA CGGTGCTGAG ACACGGGTGG
5201 ACCTCCTCTG CACCTACCTG CAGCCCCTCA GCGGCCCAGG TCTGCCTATC
5251 AAGCAGGTGT TCCATGAGCT GAGCCAGCAG ACCCATGGCA TCACCCGGCT
5301 GGGCCCCTAC TCTCTGGACA AGACAGCCT CTACCTTAAC GGTTACAATG
5351 AACCTGGTCT AGATGAGCCT CCTACAACTC CCAAGCCAGC CACCACATTC
5401 CTGCCTCCTC TGTCAGAAGC CACAACAGCC ATGGGGTACC ACCTGAAGAC
5451 CCTCACACTC AACTTCACCA TCTCCAATCT CCAGTATTCA CCAGATATGG
5501 GCAAGGGCTC AGCTACATTC AACTCCACCG AGGGGGTCCT TCAGCACCTG
5551 CTCAGACCCT TGTTCCAGAA GAGCAGCATG GGCCCCTTCT ACTTGGGTTG
5601 CCAACTGATC TCCCTCAGGC CTGAGAAGGA TGGGGCAGCC ACTGGTGTGG
5651 ACACCACCTG CACCTACCAC CCTGACCCTG TGGGCCCCGG GCTGGACATA
5701 CAGCAGCTTT ACTGGGAGCT GAGTCAGCTG ACCCATGGTG TCACCCAACT
5751 GGGCTTCTAT GTCCTGGACA GGGATAGCCT CTTCATCAAT GGCTATGCAC
5801 CCCAGAATTT ATCAATCCGG GGCGAGTACC AGATAAATTT CCACATTGTC
```

TABLE 8-continued

Complete DNA Sequence for 13 Repeats including the Carboxy Terminus of CA125 (SEQ ID NO: 49)

```
5851 AACTGGAACC TCAGTAATCC AGACCCCACA TCCTCAGAGT ACATCACCCT
5901 GCTGAGGGAC ATCCAGGACA AGGTCACCAC ACTCTACAAA GGCAGTCAAC
5951 TACATGACAC ATTCCGCTTC TGCCTGGTCA CCAACTTGAC GATGGACTCC
6001 GTGTTGGTCA CTGTCAAGGC ATTGTTCTCC TCCAATTTGG ACCCCAGCCT
6051 GGTGGAGCAA GTCTTTCTAG ATAAGACCCT GAATGCCTCA TTCCATTGGC
6101 TGGGCTCCAC CTACCAGTTG GTGGACATCC ATGTGACAGA AATGGAGTCA
6151 TCAGTTTATC AACCAACAAG CAGCTCCAGC ACCCAGCACT TCTACCCGAA
6201 TTTCACCATC ACCAACCTAC CATATTCCCA GGACAAAGCC CAGCCAGGCA
6251 CCACCAATTA CCAGAGGAAC AAAAGGAATA TTGAGGATGC GCTCAACCAA
6301 CTCTTCCGAA ACAGCAGCAT CAAGAGTTAT TTTTCTGACT GTCAAGTTTC
6351 AACATTCAGG TCTGTCCCCA ACAGGCACCA CACCGGGGTG GACTCCCTGT
6401 GTAACTTCTC GCCACTGGCT CGGAGAGTAG ACAGAGTTGC CATCTATGAG
6451 GAATTTCTGC GGATGACCCG GAATGGTACC CAGCTGCAGA ACTTCACCCT
6501 GGACAGGAGC AGTGTCCTTG TGGATGGGTA TTCTCCCAAC AGAAATGAGC
6551 CCTTAACTGG GAATTCTGAC CTTCCCTTCT GGGCTGTCAT CTTCATCGGC
6601 TTGGCAGGAC TCCTGGGACT CATCACATGC CTGATCTGCG GTGTCCTGGT
6651 GACCACCCGC CGGCGGAAGA AGGAAGGAGA ATACAACGTC AGCAACAGT
6701 GCCCAGGCTA CTACCAGTCA CACCTAGACC TGGAGGATCT GCAATGACTG
6751 GAACTTGCCG GTGCCTGGGG TGCCTTTCCC CCAGCCAGGG TCCAAGAAG
6801 CTTGGCTGGG GCAGAAATAA ACCATATTGG TCG
```

TABLE 9

Complete Amino Acid Sequence for 13 Repeats Contiguous with the Carboxy Terminus of CA125 (SEQ ID NO: 50)

```
                               1
ERVLQGLLKP LFRNSSLEYL YSGCRLASLR PEKDSSAMAV DAICTHRPDP

EDLGLDRERL YWELSNLTNG IQELGPYTLD RNSLYVNGFT HRSSMPTTST

PGTSTVDVGT SGTPSSSPSP TTAGPLLMPF TLNFTITNLQ YEEDMRRTGS
                                                    2
RKFNTMERVL QGPLSPIFKN SSVGPLYSGC RLTSLRPEKD GAATGMDAVC

LYHPNPKRPG LDREQLYWEL SQLTHNITEL GPYSLDRDSL YVNGFTHQNS

VPTTSTPGTS TVYWATTGTP SSFPGHTEPG PLLIPFTLNF TITNLQYEEN
                                              3
MGHPGSRKFN ITERVLQGLL NPIFKNSSVG PLYSGCRLTS LRPEKDGAAT

GMDAVCLYHP NPKRPGLDRE QLYCELSQLT HNITELGPYS LDRDSLYVNG

FTHQNSVPTT STPGTSTVYW ATTGTPSSFP GHTEPGPLLI PFTLNFTITN
                                                4
LQYEEDMRRT GSRKFNTMER VLQGLLKPLF KSTSVGPLYS GCRLTLLRPE

KHGAATGVDA ICTLRLDPTG PGLDRERLYW ELSQLTNSVT ELGPYTLDRD

SLYVNGFTHR SSVPTTSIPG TSAVHLETSG TPASLPGHTA PGPLLVPFTL

NFTITNLQYE EDMRHPGSRK FNTTERVLQG LLKPLFKSTS VGPLYSGCRL
    5
TLLRPEKRGA ATGVDTICTH RLDPLNPGLD REQLYWELSK LTRGIIELGP
```

TABLE 9-continued

Complete Amino Acid Sequence for 13 Repeats Contiguous
with the Carboxy Terminus of CA125 (SEQ ID NO: 50)

```
YLLDRGSLYV NGFTHRNFVP ITSTPGTSTV HLGTSETPSS LPRPIVPGPL

LIPFTLNFTI TNLQYEENMG HPGSRKFNIT ERVLQGLLKP LFRNSSLEYL
                                 6
YSGCRLASLR PEKDSSAMAV DAICTHRPDP EDLGLDRERL YWELSNLTNG

IQELGPYTLD RNSLYVNGFT HRSSMPTTST PGTSTVDVGT SGTPSSSPSP

TTAGPLLMPF TLNFTITNLQ YEEDMRRTGS RKFNTMESVL QGLLKPLFKN
                      7
TSVGPLYSGC RLTLLRPKKD GAATGVDAIC THRLDPKSPG LNREQLYWEL

SKLTNDIEEV GPYTLDRNSL YVNGFTHRSF VAPTSTLGTS TVDLGTSGTP

SSLPSPTTGV PLLIPFTLNF TITNLQYEEN MGHPGSRKFN IMERVLQGLL
                                 8
SPIFKNSSVG SLYSGCRLTL LRPEKDGAAT RVDAVCTHRP DPKSPGLDRE

RLYWKLSQLT HGIIELGPYT LDRHSFYVNG FTHQSSMTTT RTPDTSTMHL

ATSRTPASLS GPTTASPLLV LFTINFTITN QRYEENMHHP GSRKFNTTER
                                 9
VLQGLLRPVF KNTSVGPLYS GCRLTLLRPK KDGAATKVDA ICTYRPDPKS

PGLDREQLYW ELSQLTHSIT ELGPYTQDRD SLYVNGFTHR SSVPTTSIPG

TSAVHLETSG TPASLPGPSA ASPLLVLFTL NFTITNLRYE ENMQHPGSRK
                                              10
FNTTERVLQG LLRSLFKSTS VGPLYSGCRL TLLRPEKDGT ATGVDAICTH

HPDPKSPRLD REQLYWELSQ LTHNITELGH YALDNDSLFV NGFTHRSSVS

TTSTPGTPTV YLGASKTPAS IFGPSAASHL LILFTLNFTI TNLRYEENMW
                                              11
PGSRKFNTTE RVLQGLLRPL FKNTSVGPLY SGSRTLLLRP EKDGEATGVD

AICTHRPDPT GPGLDREQLY LELSQLTHSI TELGPYTLDR DSLYVNGFTH

RSSVPTTSTG VVSEEPFTLN FTINNLRYMA DMGQPGSLKF NITDNVMKHL
                                 12
LSPLFQRSSL GARYTGCRVI ALRSVKNGAE TRVDLLCTYL QPLSGPGLPI

KQVFHELSQQ THGITRLGPY SLDKDSLYLN GYNEPGLDEP PTTPKPATTF

LPPLSEATTA MGYHLKTLTL NFTISNLQYS PDMGKGSATF NSTEGVLQHL
                      13
LRPLFQKSSM GPFYLGCQLI SLRPEKDGAA TGVDTTCTYH PDPVGPGLDI

QQLYWELSQL THGVTQLGFY VLDRDSLFIN GYAPQNLSIR GEYQINFHIV

NWNLSNPDPT SSEYITLLRD IQDKVTTLYK GSQLHDTFRF CLVTNLTMDS

VLVTVKALFS SNLDPSLVEQ VFLDKTLNAS FHWLGSTYQL VDIHVTEMES

SVYQPTSSSS TQHFYLNFTI TNLPYSQDKA QPGTTNYQRN KRNIEDALNQ

LFRNSSIKSY FSDCQVSTFR SVPNRHHTGV DSLCNFSPLA RRVDRVAIYE

EFLRMTRNGT QLQNFTLDRS SVLVDGYSPN RNEPLTGNSD LPFWAVILIG

LAGLLGLITC LICGVLVTTR RRKKEGEYNV QQQCPGYYQS HLDLEDLQ
```

TABLE 10A

5'Primer Sequence for End of the Open Reading Frame for Contig #32 of Chromosome 19 Cosmid AC008734 (SEQ ID NO: 51), Primer Sequence from within the Repeat Region (SEQ ID NO: 52, 3 Primer Sets Synthesized to Piece Together Entire Open Reading Frame in Contig #32 (SEQ ID NOS: 53 thru 58), Primers to Cosmid No. AC008734 for Contig #32 (SEQ ID NOS: 59 and 60), Sense Primer Sequence (supplied by Ambion) (SEQ ID NO: 61), Anti-Sense Primer Sequence for CA125 (SEQ ID NO: 62), and 5'Sense Primer Sequence (from Ambion) (SEQ ID NO: 63) and Anti-Sense Primer Specific to CA125(SEQ ID NO: 64)

| | |
|---|---|
| (SEQ ID NO: 51) | (5'-CAGCAGAGACCAGCACGAGTACTC-3') |
| (SEQ ID NO: 52) | (5'-TCCACTGCCATGGCTGAGCT-3') |
| | Primer Sets |
| (SEQ ID NO: 53) | (Set 1) 5'-CCAGCACAGCTCTTCCCAGGAC-3' |
| (SEQ ID NO: 54) | 5'-GGAATGGCTGAGCTGACGTCTG-3') |
| (SEQ ID NO: 55) | (Set 2) 5'-CTTCCCAGGACAACCTCAAGG-3' |
| (SEQ ID NO: 56 | 5'-GCAGGATGAGTGAGCCACGTG-3' |
| (SEQ ID NO: 57) | (Set 3) 5'-GTCAGATCTGGTGACCTCACTG-3' |
| (SEQ ID NO: 58) | 5'-GAGGCACTGGAAAGCCCAGAG-3' |
| (SEQ ID NO: 59) | 5'-CTGATGGCATTATGGAACACATCAC-3' |
| (SEQ ID NO: 60) | 5'-CCCAGAACGAGAGACCAGTGAG-3' |
| (SEQ ID NO: 61) | 5'-GCTGATGGCGATGAATGAACACTG-3' |
| (SEQ ID NO: 62) | 5'-CCCAGAACGAGAGACCAGTGAG-3' |
| (SEQ ID NO: 63) | 5'-CGCGGATCCGAACACTGCGTTTGCTGGCTTTGATG-3' |
| (SEQ ID NO: 64) | 5'-CCTCTGTGTGCTGCTTCATTGGG-3' |

TABLE 10B

Sense and Anti-Sense Primers Used to Order the CA125 Carboxy Terminal Domain
(SEQ. ID NO: 303 and SEQ ID NO: 304, respectively)

| | |
|---|---|
| (SEQ ID NO: 303) | 5'-GGACAAGGTCACCACACTCTAC-3' |
| (SEQ ID NO: 304) | 5'-GCAGATCCTCCAGGTCTAGGTGTG-3' |

TABLE 10C

Sense and Anti-Sense Primers Used to Amplify Overlapping Sequences in the Repeat Domain
(SEQ ID NO: 305 and SEQ ID NO: 306, respectively)

| | |
|---|---|
| (SEQ ID NO: 305) | 5'GTC TCT ATG TCA ATG GTT TCA CCC-3' |
| (SEQ ID NO: 306) | 5'-TAG CTG CTC TCT GTC CAG TCC-3' |

TABLE 11

5'Sense Primer 1 Sequence and 3'Antisense Primer 2 (SEQ ID NO: 65 and SEQ ID NO: 66, respectively), and Nucleotide and Amino Acid Sequences of the CA125 Repeat Expressed in E. coli (SEQ ID NO: 67 and SEQ ID NO: 68, respectively)

(SEQ ID NO: 65) 5'-ACCGGATCCATGGGCCACACAGAGCCTGGCCC-3'

(SEQ ID NO: 66) 5'-TGTAAGCTTAGGCAGGGAGGATGGAGTCC-3'
(SEQ ID NO: 67)
```
  1 ATGAGAGGAT CGCATCACCA TCACCATCAC GGATCCATGG GCCACACAGA
                                                        ↑
 51 GCCTGGCCCT CCTGATAC CATTCACTTT CAACTTTACC ATCACCACC
101 TGCATTATGA GGAAAACATG CAACACCCTG GTTCCAGGAA GTTCAACACC
151 ACGGAGAGGG TTCTGCAGGG TCTGCTCAAG CCCTTGTTCA AGAACACCAG
201 TGTTGGCCCT CTGTACTCTG GCTGCAGACT GACCTTGCTC AGACCTGAGA
251 AGCATGAGGC AGCCACTGGA GTGGACACCA TCTGTACCCA CCGCGTTGAT
301 CCCATCGGAC CTGGACTGGA CAGAGAGCGG CTATACTGGG AGCTGAGCCA
351 GCTGACCAAC AGCATCACAG AGCTGGGACC CTACACCCTG GACAGGGACA
```

TABLE 11-continued

5'Sense Primer 1 Sequence and 3'Antisense Primer 2
(SEQ ID NO: 65 and SEQ ID NO: 66, respectively), and Nucleotide
and Amino Acid Sequences of the CA125 Repeat Expressed in
E. coli (SEQ ID NO: 67 and SEQ ID NO: 68, respectively)

401 GTCTCTATGT CAATGGCTTC AACCCTCGGA GCTCTGTGCC AACCACCAGC

451 ACTCCTGGGA CCTCCACAGT GCACCTGGCA ACCTCTGGGA CTCCATCCTC

501 CCTGCCT (SEQ ID NO: 68)
M R G S H H H H H H G S M G H T E P G P L L I P F T F N F T I T N L

H Y E E N M Q H P G S R K F N T T E R V L Q G L L K P L F K N T S V

G P L Y S G C R L T L L R P E K H E A A T G V D T I C T H R V D P I

G P G L D R E R L Y W E L S Q L T N S I T E L G P Y T L D R D S L Y

V N G F N P R S S V P T T S T P G T S T V H L A T S G T P S S L P

TABLE 12

Additional Multiple Repeat Amino Acid Sequences
(SEQ ID NO: 69 thru SEQ ID NO: 80)

(SEQ ID NO: 69)
ERVLQGLLGP MFKNTSVGLL YSGCRLTLLR PKKDGAATKV DAICTYRPDP

KSPGLDREQL YWELSQLTHS ITELGPYTLD RDSLYVNGFT QRSSVPTTSI

PGTPTVDLGT SGTPVSKPGP SAASPLLIPF TINFTITNLR YEENMGHPGS

RKFNIMERVL QGLLKPLFKN TSVGPLYSGC RLTLLRPKKD GAATGVDAIC

THRLDPKSPG LNREQLYWEL SKLTNDIEEL GPYTLDRNSL YVNGFTHQSS

VSTTSTPGTS TVDLRTSGTP SSLSSPTIMA AGPLLIPFTI NFTITNLRYE

ENMHHPGSRK FNTMERVLQG LLMPLFKNTS VSSLYSGCRL TLLRPEKDGA

ATRVDAVCTH RPDPKSPGLD RERLYWKLSQ LTHGITELGP YTLDRNSLYV

NGFTHRSSMP TTSTPGTSTV DVGTSGTPSS SPSPTTAGPL LMPFTLNFTI

TNLQYEEDMR RTGSRKFNTM ERVLQGLLKP LFKSTSVGPL YSGCRLTLLR

PEKHGAATGV DAICTLRLDP TGPGLDRERL YWELSQLTNS VTELGPYTLD

RDSLYVNGFT HRSSVPTTSI PGTSAVHLET SGTPASLPGH TAPGPLLIPF

TLNFTITNLH YEENMQHPGS RKFNTMERVL QGCLVPCSRN TNVGLLYSGC

RLTLLRXEKX XAATXVDXXC XXXXDPXXPG LDREXLYWEL SXLTXXIXEL

GPYTLDRNSL YVNGFTHRSS VAPTSTPGTS TVDLGTSGTP SSLPSPTTVP

LLVPFTLNFT ITNLQYGEDM RHPGSRKFNT TERVLQGLLG PLFKNSSVGP

LYSGCRLISL RSEKDGAATG VDAICTHHLN PQSPGLDREQ LYWQLSQVTN

GIKELGPYTL DRNSLYVNGF THRSSGLTTS TPWTSTVDLG TSGTPSPVPS

PTTAGPLLI (SEQ ID NO: 70)
QGLLGPMFKN TSVGLLYSGC RLTLLRPEKR GAATGVDTIC THRLDPLNPG

LDREQLYWEL SKLTRGIIEL GPYLLDRGSL YVNGFTHRNF VPITSTPGTS

TVHLGTSETP SSLPRPIVPG PLLVPFTLNF TITNLQYEEA MRHPGSRKFN

TTERVLQGLL RPLFKNTSVS SLYSGCRLTL LRPEKDGAAT RVDAACTYRP

DPKSPGLDRE QLYWELSQLT HSITELGPYT LDRVSLYVNG FNPRSSVPTT

TABLE 12-continued

Additional Multiple Repeat Amino Acid Sequences
(SEQ ID NO: 69 thru SEQ ID NO: 80)

STPGTSTVHL ATSGTPSSLP GHTAPVPLLI PFTLNFTITN LQYEEDMRHP

GSRKFNTMER VLQGLLRPLF KNTSIGPLYS SCRLTLLRPE KDKAATRVDA

ICTHHPDPQS PGLNREQLYW ELSQLTHGIT ELGPYTLDRD SLYVDGFTHW

SPIPTTSTPG TSIVNLGTSG IPPSLPETTA TGPLLIPFTP NFTITNLQYE

EDMRRTGSRK FNTMERVLQG LLSPIFKNSS VGPLYSGCRL TSLRPEKDGA

ATGMDAVCLY HPNPKRPGLD REQLY (SEQ ID NO:71)
ERVLQGLLKP LFKSTSVGPL YSGCRLTLLR PEKDGVATRV DAICTHRPDP

KIPGLDRQQL YWELSQLTHS ITELGPYTLD RDSLYVNGFT QRSSVPTTST

PGTFTVQPET SETPSSLPGP TATGPVLLPF TLNFTIINLQ YEEDMHRPGS

RKFNTTERVL QGLLMPLFKN TSVGPLYSGC RLTLLRPEKQ EAATGVDTIC

THRLDPSEPG LDREQLYWEL SQLTNSITEL GPYTLDRDSL YVNGFTHSGV

LCPPPSILGI FTVQPETFET PSSLPGPTAT GPVLLPFTLN FTIINLQYEE

DMHRPGSRKF NTTERVLQGL LTPLFKNTSV GPLYSGCRLT LLRPEKQEAA

TGVDTICTHR VDPIGPGLDR ERLYWELSQL TNSITELGPY TLDRDSLYVN

GFNPWSSVPT TSTPGTSTVH LATSGTPSSL PGHTAPVPLL IPFTLNFTIT

NLHYEENMQH PGSRKFNTTE RVLQGLLKPL FKSTSVGPLY SGCRLTLLRP

EKHGAATGVD AICTHRLDPK SPGVDREQLY WELSQLTNGI KELGPYTLDR

NSLYVNGFTH WIPVPTSSTP GTSTVDLGSG TPSSLPSPTT AGPL (SEQ ID NO: 72)
TSVGPLYSGC RLTLLRSEKD GAATGVDAIY THRLDPKSPG VDREQLYWEL

SQLTNGIKEL GPYTLDRNSL YVNGFTHQTS APNTSTPGTS TVDLGTSGTP

SSLPSPTSAG PLLIPFTINF TITNLRYEEN MHHPGSRKFN TMERVLQGLL

KPLFKSTSVG PLYSGCRLTL LRPEKDGVAT RVDAICTHRP DPKIPGLDRQ

QLYWELSQLT HSITELGPYT LDRDSLYVNG FTQRSSVPTT STPGTFTVQP

ETSETPSSLP GPTATGPVLL PFTLNFTIIN LQYEEDMHRP GSRKFNTTER

VLQGLLKPLF KSTSVGPLYS GCRLTLLRPE KHGAATGVDA ICTLRLDPTG

PGLDRERLYW ELSQLTNSIT ELGPYTLDRD SLYVNGFNPW SSVPTTSTPG

TSTVHLATSG TPSSLPGHTA PVPL (SEQ ID NO:73)
ERVLQGLLKP LFKSTSVGPL YSGCRLTLLR PEKRGAATGV DTICTHRLDP

LNPGLDREQL YWELSKLTRG IIELGPYLLD RDSLYVNGFT HRSSVPTTSI

PGTSAVHLET SGTPASLPGH TAPGPLLVPF TLNFTITNLQ YEEDMRHPGS

RKFNTTERVL QGLLKPLFKS TSVGPLYSGC RLTLLRPEKR GAATGVDTIC

THRLDPLNPG LDREQLYWEL SKLTRGIIEL GPYLLDRGSL YVNGFTHRNF

VPITSTPGTS TVHLGTSETP SSLPRPIVPG PLLIPF (SEQ ID NO: 74)
ERVLQGLLRP VFKNTSVGPL YSGCRLTLLR PKKDGAATKV DAICTYRPDP

KSPGLDREQL YWELSQLTHS ITELGPYTLD RDSLYVNGFT QRSSVPTTSI

PGTPTVDLGT SGTPVSKPGP SAASPLLVPF TLNFTITNLQ YEEDMHRPGS

RKFNATERVL QGLLSPIFKN SSVGPLYSGC RLTSLRPEKD GAATGMDAVC

TABLE 12-continued

Additional Multiple Repeat Amino Acid Sequences
(SEQ ID NO: 69 thru SEQ ID NO: 80)

```
LYHPNPKRPG LDREQLYWEL SQLTHNITEL GPYSLDRDSL YVNGFTHQSS
MTTTRTPDTS TMHLATSRTP ASLSGPTTAS PLLIPF
                                                   (SEQ ID NO: 75)
ERVLQGLLKP LFKSTSVGPL YSGCRLTLLR PEKRGAATGV DTICTHRLDP
LNPGLDREQL YWELSKLTRG IIELGPYLLD RGSLYVNGFS RQSSMTTTRT
PDTSTMHLAT SRTPASLSGP TTASPLLIPF TLNFTITNLQ YEENMGHPGS
RKFNIMERVL QGLLNPIFKN SSVGPLYSGC RLTSLKPEKD GAATGMDAVC
LYHPNPKRPG LDREQLYWEL SQLTHGIKEL GPYTLDRNSL YVNGFTHRSS
VAPTSTPGTS TVDLGTSGTP SSLPSPTTAV PLLIPF
                                                   (SEQ ID NO: 76)
ERVLQGLLKP LFRNSSLEYL YSGCRLASLR PEKDSSAMAV DAICTHRPDP
EDLGLDRERL YWELSNLTNG IQELGPYTLD RNSLYVNGFT HRSSGLTTST
PWTSTVDLGT SGTPSPVPSP TTAGPLLIPF TLNFTITNLQ YEENMGHPGS
RKFNIMERVL QGLLMPLFKN TSVSSLYSGC RLTLLRPEKD GAATRVDAVC
TQRPDPKSPG LDRERLYWKL SQLTHGITEL GPYTLDRHSL YVNGLTHQSS
MTTTRTPDTS TMHLATSRTP ASLSGPTTAS PLLIPF
                                                   (SEQ ID NO: 77)
ERVLQGLLSP ISKNSSVGPL YSGCRLTSLR PEKDGAATGM DAVCLYHPNP
KRPGLDREQL YWELSQLTHN ITELGPYSLD RDSLYVNGFT HQNSVPTTST
PGTSTVYWAT TGTPSSFPGH TEPGPLLIPF TVNFTITNLR YEENMHHPGS
RKFNTTERVL QGLLRPVFKN TSVGPLYSGC RLTLLRPKKD GAATKVDAIC
TYRPDPKSPG LDREQLYWEL SKLTNDIEEL GPYTLDRNSL YVNGFTHQSS
VSTTSTPGTS TVDLRTSGTP SSLSSPTIMA AGPLLIPF
                                                   (SEQ ID NO: 78)
ERVLHGLLTP LFKNTRVGPL YSGCRLTLLR PEKQEAATGV DTICTHRVDP
IGPGLDRERL YWELSQLTNS ITELGPYTLD RDSLYVNGFN PWSSVPTTST
PGTSTVHLAT SGTPSSLPGH TAPVPLLIPF TLNFTITNLH YEENMQHPGS
RKFNTTERVL QGLLKPLFKN TSVGPLYSGC RLTLFKPEKH EAATGVDAIC
TLRLDPTGPG LDRQLYWELS QLTNSVTELG PYTLDRDSLY VNGFTHRSSV
PTTSIPGTSA VHLETSGTPA SLPGHTAPGP LLIPFTLNFT ITNLQYEEDM
RRTGSRKFNT MERVLQGLLK PLFKSTSVGP LYSGCRLTLL RPEKRGAATG
VDTICTHRLD PLNPGLDREQ LYWELSKLTR GIIELGPYLL DRGSLYVNGF
THRNFVPITS TPGTSTVHLG TSETPSSLPR PIVPGPLLIP FTINFTITNL
RYEENMHHPG SRKFNIMERV LQGLLGPLFK NSSVGPLYSG CRLISLRSEK
DGAATGVDAI CTHHLNPQSP GLDREQLYWQ LSQMTNGIKE LGPYTLDRNS
LYVNGFTHRS SGLTTSTPWT STVDLGTSGT PSPVPSPTTA GPLLIPF
                                                   (SEQ ID NO: 79)
GPLYSGCRLT SLRPEKDGAA TGMDAVCLYH PNPKRPGLDR EQLYWELSQL
THNITELGPY SLDRDSLYVN GFTHQNSVPT TSTPGTSTVY WATTGTPSSF
PGHTEPGPLL IPFTLNFTIT NLQYEENMGH PGSRKFNITE SVLQGLLTPL
FKNSSVGPLY SGCRLISLRS EKDGAATGVD AICTHHLNPQ SPGLDREQLY
```

TABLE 12-continued

Additional Multiple Repeat Amino Acid Sequences
(SEQ ID NO: 69 thru SEQ ID NO: 80)

WQLSQMTNGI KELGPYTLDR DSLYVNGFTH RSLGLTTSTP WTSTVDLGTS

GTPSPVPSPT TAGPLLIPFT LNFTITNLQY EENMGHPGSR KFNIMERVLQ

GLLRPVFKNT SVGPLYSGCR LTLLRPKKDG AATKVDAICT YRPDPKSPGL

DREQLYWELS QLTHSITELG PYTLDRDSLY VNGFTQRSSV PTTSIPGTPT

VDLGTSGTPV SKPGPSAASP (SEQ ID NO: 80)
QLYWELSKLT NDIEELGPYT LDRNSLYVNG FTHQSSVSTT STPGTSTVDL

RTSGTPSSLS SPTIMAAGPL LIPFTLNFTI TNLQYEENMG HPGSRKFNIM

ERVLQGLLGP MFKNTSVGLL YSGCRLTLLR PEKNGAATGM DAICSHRLDP

KSPGLNREQL YWELSQLTHG IKELGPYTLD RNSLYVNGFT HRSSVAPTST

PGTSTVDLGT SGTPSSLPSP TTAVPLLIPF TLNFTITNLK YEEDMHCPGS

RKFNTTERVL QSLFGPMFKN TSVGPLYSGC RLTLLRSEKD GAATGVDAIC

THRLDPKSLG VDREQLYWEL SQLTNGIKEL GPYTLDRNSL YVNGFTHQTS

APNTSTPGTS TVDLGTSGTP SSLPSPTSAG PLLVPFTLNF TITNLQYEED

MRRTGSRKFN TMESVLQGLL KPLFKNTSVG PLYSGCRLTL LRPEKDGAAT

GVDAICTHRL DPKSPGLNRE QLYWELSKL

TABLE 13

Amino Terminal Nucleotide Sequence (SEQ ID NO: 81)

```
  1 CAGAGAGCGT TGAGCTGGGA ACAGTGACAA GTGCTTATCA AGTTCCTTCA
 51 CTCTCAACAC GGTTGACAAG AACTGATGGC ATTATGGAAC ACATCACAAA
101 AATACCCAAT GAAGCAGCAC ACAGAGGTAC CATAAGACCA GTCAAGGCC
151 CTCAGACATC CACTTCGCCT GCCAGTCCTA AAGGACTACA CACAGGAGGG
201 ACAAAAAGAA TGGAGACCAC CACCACAGCT TTGAAGACCA CCACCACAGC
251 TTTGAAGACC ACTTCCAGAG CCACCTTGAC CACCAGTGTC TATACTCCCA
301 CTTTGGGAAC ACTGACTCCC CTCAATGCAT CAAGGCAAAT GGCCAGCACA
351 ATCCTCACAG AAATGATGAT CACAACCCCA TATGTTTTCC CTGATGTTCC
401 AGAAACGACA TCCTCATTGG CTACCAGCCT GGGAGCAGAA ACCAGCACAG
451 CTCTTCCCAG ACAACCCCA TCTGTTCTCA ATAGAGAATC AGAGACCACA
501 GCCTCACTGG TCTCTCGTTC TGGGGCAGAG AGAAGTCCGG TTATTCAAAC
551 TCTAGATGTT TCTTCTAGTG AGCCAGATAC AACAGCTTCA TGGGTTATCC
601 ATCCTGCAGA GACCATCCCA ACTGTTTCCA AGACAACCCC CAATTTTTC
651 CACAGTGAAT TAGACACTGT ATCTTCCACA GCCACCAGTC ATGGGGCAGA
701 CGTCAGCTCA GCCATTCCAA CAAATATCTC ACCTAGTGAA CTAGATGCAC
751 TGACCCCACT GGTCACTATT TCGGGGACAG ATACTAGTAC AACATTCCCA
801 ACACTGACTA GTCCCCACA TGAAACAGAG ACAAGAACCA CATGGCTCAC
851 TCATCCTGCA GAGACCAGCT CAACTATTCC CAGAACAATC CCCAATTTTT
901 CTCATCATGA ATCAGATGCC ACACCTTCAA TAGCCACCAG TCCTGGGGCA
```

TABLE 13-continued

Amino Terminal Nucleotide Sequence (SEQ ID NO: 81)

```
 951 GAAACCAGTT CAGCTATTCC AATTATGACT GTCTCACCTG GTGCAGAAGA
1001 TCTGGTGACC TCACAGGTCA CTAGTTCTGG GACAGACAGA AATATGACTA
1051 TTCCAACTTT GACTCTTTCT CCTGGTGAAC CAAAGACGAT AGCCTCATTA
1101 GTCACCCATC CTGAAGCACA GACAAGTTCG GCCATTCCAA CTTCAACTAT
1151 CTCGCCTGCT GTATCACGGT TGGTGACCTC AATGGTCACC AGTTTGGCGG
1201 CAAAGACAAG TACAACTAAT CGAGCTCTGA CAAACTCCCC TGGTGAACCA
1251 GCTACAACAG TTTCATTGGT CACGCATCCT GCACAGACCA GCCCAACAGT
1301 TCCCTGGACA ACTTCCATTT TTTTCCATAG TAAATCAGAC ACCACACCTT
1351 CAATGACCAC CAGTCATGGG GCAGAATCCA GTTCAGCTGT TCCAACTCCA
1401 ACTGTTTCAA CTGAGGTACC AGGAGTAGTG ACCCCTTTGG TCACCAGTTC
1451 TAGGGCAGTG ATCAGTACAA CTATTCCAAT TCTGACTCTT TCTCCTGGTG
1501 AACCAGAGAC CACACCTTCA ATGGCCACCA GTCATGGGGA AGAAGCCAGT
1551 TCTGCTATTC AACTCCAAC TGTTTCACCT GGGGTACCAG GAGTGGTGAC
1601 CTCTCTGGTC ACTAGTTCTA GGGCAGTGAC TAGTACAACT ATTCCAATTC
1651 TGACTTTTTC TCTTGGTGAA CCAGAGACCA CACCTTCAAT GGCCACCAGT
1701 CATGGGACAG AAGCTGGCTC AGCTGTTCCA ACTGTTTTAC CTGAGGTACC
1751 AGGAATGGTG ACCTCTCTGG TTGCTAGTTC TAGGGCAGTA ACCAGTACAA
1801 CTCTTCCAAC TCTGACTCTT TCTCCTGGTG AACCAGAGAC CACACCTTCA
1851 ATGGCCACCA GTCATGGGGC AGAAGCCAGC TCAACTGTTC CAACTGTTTC
1901 ACCTGAGGTA CCAGGAGTGG TGACCTCTCT GGTCACTAGT TCTAGTGGAG
1951 TAAACAGTAC AAGTATTCCA ACTCTGATTC TTTCTCCTGG TGAACTAGAA
2001 ACCACACCTT CAATGGCCAC CAGTCATGGG GCAGAAGCCA GCTCAGCTGT
2051 TCCAACTCCA ACTGTTTCAC TGGGGTATC AGGAGTGGTG ACCCCTCTGG
2101 TCACTAGTTC CAGGGCAGTG ACCAGTACAA CTATTCCAAT TCTAACTCTT
2151 TCTTCTAGTG AGCCAGAGAC CACACCTTCA ATGGCCACCA GTCATGGGGT
2201 AGAAGCCAGC TCAGCTGTTC TAACTGTTTC ACCTGAGGTA CCAGGAATGG
2251 TGACCTCTCT GGTCACTAGT TCTAGAGCAG TAACCAGTAC AACTATTCCA
2301 ACTCTGACTA TTTCTTCTGA TGAACCAGAG ACCACAACTT CATTGGTCAC
2351 CCATTCTGAG GCAAAGATGA TTTCAGCCAT TCCAACTTTA GCTGTCTCCC
2401 CTACTGTACA AGGGCTGGTG ACTTCACTGG TCACTAGTTC TGGGTCAGAG
2451 ACCAGTGCGT TTTCAAATCT AACTGTTGCC TCAAGTCAAC CAGAGACCAT
2501 AGACTCATGG GTCGCTCATC CTGGGACAGA AGCAAGTTCT GTTGTTCCAA
2551 CTTTGACTGT CTCCACTGGT GAGCCGTTTA CAAATATCTC ATTGGTCACC
2601 CATCCTGCAG AGAGTAGCTC AACTCTTCCC AGGACAACCT CAAGGTTTTC
2651 CCACAGTGAA TTAGACACTA TGCCTTCTAC AGTCACCAGT CCTGAGGCAG
2701 AATCCAGCTC AGCCATTTCA ACTACTATTT CACCTGGTAT ACCAGGTGTG
2751 CTGACATCAC TGGTCACTAG CTCTGGGAGA GACATCAGTG CAACTTTTCC
2801 AACAGTGCCT GAGTCCCCAC ATGAATCAGA GGCAACAGCC TCATGGGTTA
2851 CTCATCCTGC AGTCACCAGC ACAACAGTTC CAGGACAAC CCCTAATTAT
```

TABLE 13-continued

Amino Terminal Nucleotide Sequence (SEQ ID NO: 81)

```
2901 TCTCATAGTG AACCAGACAC CACACCATCA ATAGCCACCA GTCCTGGGGC
2951 AGAAGCCACT TCAGATTTTC AACAATAAC TGTCTCACCT GATGTACCAG
3001 ATATGGTAAC CTCACAGGTC ACTAGTTCTG GGACAGACAC CAGTATAACT
3051 ATTCCAACTC TGACTCTTTC TTCTGGTGAG CCAGAGACCA CAACCTCATT
3101 TATCACCTAT TCTGAGACAC ACACAAGTTC AGCCATTCCA ACTCTCCCTG
3151 TCTCCCCTGG TGCATCAAAG ATGCTGACCT CACTGGTCAT CAGTTCTGGG
3201 ACAGACAGCA CTACAACTTT CCCAACACTG ACGGAGACCC CATATGAACC
3251 AGAGACAACA GCCATACAGC TCATTCATCC TGCAGAGACC AACACAATGG
3301 TTCCCAAGAC AACTCCCAAG TTTTCCCATA GTAAGTCAGA CACCACACTC
3351 CCAGTAGCCA TCACCAGTCC TGGGCCAGAA GCCAGTTCAG CTGTTTCAAC
3401 GACAACTATC TCACCTGATA TGTCAGATCT GGTGACCTCA CTGGTCCCTA
3451 GTTCTGGGAC AGACACCAGT ACAACCTTCC CAACATTGAG TGAGACCCCA
3501 TATGAACCAG AGACTACAGT CACGTGGCTC ACTCATCCTG CAGAAACCAG
3551 CACAACGGTT TCTGGGACAA TTCCCAACTT TTCCCATAGG GGATCAGACA
3601 CTGCACCCTC AATGGTCACC AGTCCTGGAG TAGACACGAG GTCAGGTGTT
3651 CCAACTACAA CCATCCCACC CAGTATACCA GGGGTAGTGA CCTCACAGGT
3701 CACTAGTTCT GCAACAGACA CTAGTACAGC TATTCCAACT TTGACTCCTT
3751 CTCCTGGTGA ACCAGAGACC ACAGCCTCAT CAGCTACCCA TCCTGGGACA
3801 CAGACTGGCT TCACTGTTCC AATTCGGACT GTTCCCTCTA GTGAGCCAGA
3851 TACAATGGCT TCCTGGGTCA CTCATCCTCC ACAGACCAGC ACACCTGTTT
3901 CCAGAACAAC CTCCAGTTTT TCCCATAGTA GTCCAGATGC CACACCTGTA
3951 ATGGCCACCA GTCCTAGGAC AGAAGCCAGT TCAGCTGTAC TGACAACAAT
4001 CTCACCTGGT GCACCAGAGA TGGTGACTTC ACAGATCACT AGTTCTGGGG
4051 CAGCAACCAG TACAACTGTT CCAACTTTGA CTCATTCTCC TGGTATGCCA
4101 GAGACCACAG CCTTATTGAG CACCCATCCC AGAACAGGGA CAAGTAAAAC
4151 ATTTCCTGCT TCAACTGTGT TTCCTCAAGT ATCAGAGACC ACAGCCTCAC
4201 TCACCATTAG ACCTGGTGCA GAGACTAGCA CAGCTCTCCC AACTCAGACA
4251 ACATCCTCTC TCTTCACCCT ACTTGTAACT GGAACCAGCA GAGTTGATCT
4301 AAGTCCAACT GCTTCACCTG GTGTTTCTGC AAAAACAGCC CCACTTTCCA
4351 CCCATCCAGG GACAGAGACC AGCACAATGA TTCCAACTTC AACTCTTTCC
4401 CTTGGTTTAC TAGAGACTAC AGGCTTACTG GCCACCAGCT CTTCAGCAGA
4451 GACCAGCACG AGTACTCTAA CTCTGACTGT TTCCCCTGCT GTCTCTGGGC
4501 TTTCCAGTGC CTCTATAACA ACTGATAAGC CCCAAACTGT GACCTCCTGG
4551 AACACAGAAA CCTCACCATC TGTAACTTCA GTTGGACCCC CAGAATTTTC
4601 CAGGACTGTC ACAGGCACCA CTATGACCTT GATACCATCA GAGATGCCAA
4651 CACCACCTAA AACCAGTCAT GGAGAAGGAG TGAGTCCAAC CACTATCTTG
4701 AGAACTACAA TGGTTGAAGC CACTAATTTA GCTACCACAG GTTCCAGTCC
4751 CACTGTGGCC AAGACAACAA CCACCTTCAA TACACTGGCT GGAAGCCTCT
4801 TTACTCCTCT GACCACACCT GGGATGTCCA CCTTGGCCTC TGAGAGTGTG
```

TABLE 13-continued

Amino Terminal Nucleotide Sequence (SEQ ID NO: 81)

```
4851 ACCTCAAGAA CAAGTTATAA CCATCGGTCC TGGATCTCCA CCACCAGCAG
4901 TTATAACCGT CGGTACTGGA CCCCTGCCAC CAGCACTCCA GTGACTTCTA
4951 CATTCTCCCC AGGGATTTCC ACATCCTCCA TCCCCAGCTC ACAGCAGCC
5001 ACAGTCCCAT TCATGGTGCC ATTCACCCTC AACTTCACCA TCACCAACCT
5051 GCAGTACGAG GAGGACATGC GGCACCCTGG TTCCAGGAAG TTCAACGCCA
5101 CAGAGAGAGA ACTGCAGGGT CTGCTCAAAC CCTTGTTCAG GAATAGCAGT
5151 CTGGAATACC TCTATTCAGG CTGCAGACTA GCCTCACTCA GGCCAGAGAA
5201 GGATAGCTCA GCCATGGCAG TGGATGCCAT CTGCACACAT CGCCCTGACC
5251 CTGAAGACCT CGGACTGGAC AGAGAGCGAC TGTACTGGGA GCTGAGCAAT
5301 CTGACAAATG GCATCCAGGA GCTGGGCCCC TACACCCTGG ACCGGAACAG
5351 TCTCTATGTC AATGGTTTCA CCCATCGAAG CTCTATGCCC ACCACCAGCA
5401 CTCCTGGGAC CTCCACAGTG GATGTGGGAA CCTCAGGGAC TCCATCCTCC
5451 AGCCCCAGCC CCACG
```

TABLE 14

Amino Terminal Protein Sequence (SEQ ID NO: 82)

```
   1 ESVLEGTVTS AYQVPSLSTR LTRTDGIMEH ITKIPNEAAH RGTIRPVKGP
  51 QTSTSPASPK GLHTGGTKRM ETTTTALKTT TTALKTTSRA TLTTSVYTPT
 101 LGTLTPLNAS RQMASTILTE MMITTPYVFP DVPETTSSLA TSLGAETSTA
 151 LPRTTPSVLN RESETTASLV SRSGAERSPV IQTLDVSSSE PDTTASWVIH
 201 PAETIPTVSK TTPNFFHSEL DTVSSTATSH GADVSSAIPT NISPSELDAL
 251 TPLVTISGTD TSTTFPTLTK SPHETETRTT WLTHPAETSS TIPRTIPNFS
 301 HHESDATPSI ATSPGAETSS AIPIMTVSPG AEDLVTSQVT SSGTDRNMTI
 351 PTLTLSPGEP KTIASLVTHP EAQTSSAIPT STISPAVSRL VTSMVTSLAA
 401 KTSTTNRALT NSPGEPATTV SLVTHPAQTS PTVPWTTSIF FHSKSDTTPS
 451 MTTSHGAESS SAVPTPTVST EVPGVVTPLV TSSRAVISTT IPILTLSPGE
 501 PETTPSMATS HGEEASSAIP TPTVSPGVPG VVTSLVTSSR AVTSTTIPIL
 551 TFSLGEPETT PSMATSHGTE AGSAVPTVLP EVPGMVTSLV ASSRAVTSTT
 601 LPTLTLSPGE PETTPSMATS HGAEASSTVP TVSPEVPGVV TSLVTSSSGV
 651 NSTSIPTLIL SPGELETTPS MATSHGAEAS SAVPTPTVSP GVSGVVTPLV
 701 TSSRAVTSTT IPILTLSSSE PETTPSMATS HGVEASSAVL TVSPEVPGMV
 751 TSLVTSSRAV TSTTIPTLTI SSDEPETTTS LVTHSEAKMI SAIPTLAVSP
 801 TVQGLVTSLV TSSGSETSAF SNLTVASSQP ETIDSWVAHP GTEASSVVPT
 851 LTVSTGEPFT NISLVTHPAE SSSTLPRTTS RFSHSELDTM PSTVTSPEAE
 901 SSSAISTTIS PGIPGVLTSL VTSSGRDISA TFPTVPESPH ESEATASWVT
 951 HPAVTSTTVP RTTPNYSHSE PDTTPSIATS PGAEATSDFP TITVSPDVPD
1001 MVTSQVTSSG TDTSITIPTL TLSSGEPETT TSFITYSETH TSSAIPTLPV
1051 SPGASKMLTS LVISSGTDST TTFPTLTETP YEPETTAIQL IHPAETNTMV
1101 PRTTPKFSHS KSDTTLPVAI TSPGPEASSA VSTTTISPDM SDLVTSLVPS
```

TABLE 14-continued

Amino Terminal Protein Sequence (SEQ ID NO: 82)

```
1151 SGTDTSTTFP TLSETPYEPE TTATWLTHPA ETSTTVSGTI PNFSHRGSDT

1201 APSMVTSPGV DTRSGVPTTT IPPSIPGVVT SQVTSSATDT STAIPTLTPS

1251 PGEPETTASS ATHPGTQTGF TVPIRTVPSS EPDTMASWVT HPPQTSTPVS

1301 RTTSSFSHSS PDATPVMATS PRTEASSAVL TTISPGAPEM VTSQITSSGA

1351 ATSTTVPTLT HSPGMPETTA LLSTHPRTET SKTFPASTVF PQVSETTASL

1401 TIRPGAETST ALPTQTTSSL FTLLVTGTSR VDLSPTASPG VSAKTAPLST

1451 HPGTETSTMI PTSTLSLGLL ETTGLLATSS SAETSTSTLT LTVSPAVSGL

1501 SSASITTDKP QTVTSWNTET SPSVTSVGPP EFSRTVTGTT MTLIPSEMPT

1551 PPKTSHGEGV SPTTILRTTM VEATNLATTG SSPTVAKTTT TFNTLAGSLF

1601 TPLTTPGMST LASESVTSRT SYNHRSWIST TSSYNRRYWT PATSTPVTST
                         *
1651 FSPGISTSSI PSSTAATVPF MVPFTLNFTI TNLQYEEDMR HPGSRKFNAT

1701 ERELQGLLKP LFRNSSLEYL YSGCRLASLR PEKDSSAMAV DAICTHRPDP

1751 EDLGLDRERL YWELSNLTNG IQELGPYTLD RNSLYVNGFT HRSSMPTTST

1801 PGTSTVDVGT SGTPSSSPSP T
```

TABLE 15

CA125 Repeat Nucleotide Sequence
(SEQ ID NO: 83 thru SEQ ID NO: 145)

(SEQ ID NO: 83)
```
  1 GCCACAGTCC CATTCATGGT GCCATTCACC CTCAACTTCA CCATCACCAA

51 CCTGCAGTAC GAGGAGGACA TGCGGCACCC TGGTTCCAGG AAGTTCAACG

101 CCACAGAGAG AGAACTGCAG GGTCTGCTCA AACCCTTGTT CAGGAATAGC

151 AGTCTGGAAT ACCTCTATTC AGGCTGCAGA CTAGCCTCAC TCAGGCCAGA

201 GAAGGATAGC TCAGCCATGG CAGTGGATGC CATCTGCATA CATCGCCCTG

251 ACCCTGAAGA CCTCGGACTG GACAGAGAGC GACTGTACTG GGAGCTGAGC

301 AATCTGACAA ATGGCATCCA GGAGCTGGGC CCCTACACCC TGGACCGGAA

351 CAGTCTCTAT GTCAATGGTT TCACCCATCG AAGCTCTATG CCCACCACCA

401 GCACTCCTGG GACCTCCACA GTGGATGTGG GAACCTCAGG GACTCCATCC

451 TCCAGCCCCA GCCCCACG
```

(SEQ ID NO: 84)
```
  1 GCTGCTGGCC CTCTCCTGAT GCCGTTCACC CTCAACTTCA CCATCACCAA

51 CCTGCAGTAC GAGGAGGACA TGCGTCGCAC TGGCTCCAGG AAGTTCAACA

101 CCATGGAGAG TGTCCTGCAG GGTCTGCTCA AGCCCTTGTT CAAGAACACC

151 AGTGTTGGCC CTCTGTACTC TGGCTGCAGA TTGACCTTGC TCAGGCCCAA

201 GAAAGATGGG GCAGCCACTG GAGTGGATGC CATCTGCACC CACCGCCTTG

251 ACCCCAAAAG CCCTGGACTC AACAGGGAGC AGCTGTACTG GGAGCTAAGC

301 AAACTGACCA ATGACATTGA AGAGCTGGGC CCCTACACCC TGGACAGGAA

351 CAGTCTCTAT GTCAATGGTT TCACCCATCA GAGCTCTGTG TCCACCACCA

401 GCACTCCTGG GACCTCCACA GTGGATCTCA GAACCTCAGG GACTCCATCC

451 TCCCTCTCCA GCCCCACAAT TATG
```

TABLE 15-continued

CA125 Repeat Nucleotide Sequence
(SEQ ID NO: 83 thru SEQ ID NO: 145)

(SEQ ID NO: 85)
```
  1 GCTGCTGGCC CTCTCCTGGT ACCATTCACC CTCAACTTCA CCATCACCAA
 51 CCTGCAGTAT GGGGAGGACA TGGGTCACCC TGGCTCCAGG AAGTTCAACA
101 CCACAGAGAG GGTCCTGCAG GGTCTGCTTG GTCCCATATT CAAGAACACC
151 AGTGTTGGCC CTCTGTACTC TGGCTGCAGA CTGACCTCTC TCAGGTCTGA
201 GAAGGATGGA GCAGCCACTG GAGTGGATGC CATCTGCATC CATCATCTTG
251 ACCCCAAAAG CCCTGGACTC AACAGAGAGC GGCTGTACTG GGAGCTGAGC
301 CAACTGACCA ATGGCATCAA AGAGCTGGGC CCCTACACCC TGGACAGGAA
351 CAGTCTCTAT GTCAATGGTT TCACCCATCG GACCTCTGTG CCCACCACCA
401 GCACTCCTGG GACCTCCACA GTGGACCTTG AACCTCAGG  GACTCCATTC
451 TCCCTCCCAA GCCCCGCA
```

(SEQ ID NO: 86)
```
  1 ACTGCTGGCC CTCTCCTGGT GCTGTTCACC CTCAACTTCA CCATCACCAA
 51 CCTGAAGTAT GAGGAGGACA TGCATCGCCC TGGCTCCAGG AAGTTCAACA
101 CCACTGAGAG GGTCCTGCAG ACTCTGCTTG GTCCTATGTT CAAGAACACC
151 AGTGTTGGCC TTCTGTACTC TGGCTGCAGA CTGACCTTGC TCAGGTCCGA
201 GAAGGATGGA GCAGCCACTG GAGTGGATGC CATCTGCACC CACCGTCTTG
251 ACCCCAAAAG CCCTGGACTG GACAGAGAGC AGCTATACTG GGAGCTGAGC
301 CAGCTGACCA ATGGCATCAA AGAGCTGGGC CCCTACACCC TGGACAGGAA
351 CAGTCTCTAT GTCAATGGTT TCACCCATTG GATCCCTGTG CCCACCAGCA
401 GCACTCCTGG GACCTCCACA GTGGACCTTG GGTCAGGGAC TCCATCCTCC
451 CTCCCCAGCC CCACA
```

(SEQ ID NO: 87)
```
  1 GCTGCTGGCC CTCTCCTGGT GCCATTCACC CTCAACTTCA CCATCACCAA
 51 CCTGCAGTAC GAGGAGGACA TGCATCACCC AGGCTCCAGG AAGTTCAACA
101 CCACGGAGCG GGTCCTGCAG GGTCTGCTTG GTCCCATGTT CAAGAACACC
151 AGTGTCGGCC TTCTGTACTC TGGCTGCAGA CTGACCTTGC TCAGGTCCGA
201 GAAGGATGGA GCAGCCACTG GAGTGGATGC CATCTGCACC CACCGTCTTG
251 ACCCCAAAAG CCCTGGAGTG GACAGGGAGC AGCTATACTG GGAGCTGAGC
301 CAGCTGACCA ATGGCATCAA AGAGCTGGGT CCCTACACCC TGGACAGAAA
351 CAGTCTCTAT GTCAATGGTT TCACCCATCA GACCTCTGCG CCCAACACCA
401 GCACTCCTGG GACCTCCACA GTGGACCTTG GACCTCAGG  GACTCCATCC
451 TCCCTCCCCA GCCCTACA
```

(SEQ ID NO: 88)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGNG NGTNCTGCAG GGTCTGCTNN NNCCCNTNTT CAAGAACACC
151 AGTGTTGGCC CTCTGTACTC TGGCTGCAGA CTGACCTTGC TCAGGTCCGA
201 GAAGGATGGA GCAGCCACTG GAGTGGATGC CATCTGCACC CACCGTCTTG
251 ACCCCAAAAG CCCTGGAGTG GACAGGGAGC AGCTATACTG GGAGCTGAGC
```

TABLE 15-continued

CA125 Repeat Nucleotide Sequence
(SEQ ID NO: 83 thru SEQ ID NO: 145)

```
301 CAGCTGACCA ATGGCATCAA AGAGCTGGGT CCCTACACCC TGGACAGAAA
351 CAGTCTCTAT GTCAATGGTT TCACCCATCA GACCTCTGCG CCCAACACCA
401 GCACTCCTGG GACCTCCACA GTGGACCTTG GGACCTCAGG GACTCCATCC
451 TCCCTCCCCA GCCCTACA
```

(SEQ ID NO: 89)
```
  1 TCTGCTGGCC CTCTCCTGGT GCCATTCACC CTCAACTTCA CCATCACCAA
 51 CCTGCAGTAC GAGGAGGACA TGCATCACCC AGGCTCCAGG AAGTTCAACA
101 CCACGGAGCG GGTCCTGCAG GGTCTGCTTG GTCCCATGTT CAAGAACACC
151 AGTGTCGGCC TTCTGTACTC TGGCTGCAGA CTGACCTTGC TCAGGCCTGA
201 GAAGAATGGG GCAGCCACTG GAATGGATGC CATCTGCAGC CACCGTCTTG
251 ACCCCAAAAG CCCTGGACTC AACAGAGAGC AGCTGTACTG GGAGCTGAGC
301 CAGCTGACCC ATGGCATCAA AGAGCTGGGC CCCTACACCC TGGACAGGAA
351 CAGTCTCTAT GTCAATGGTT TCACCCATCG GAGCTCTGTG GCCCCCACCA
401 GCACTCCTGG GACCTCCACA GTGGACCTTG GGACCTCAGG GACTCCATCC
451 TCCCTCCCCA GCCCCACA
```

(SEQ ID NO: 90)
```
  1 ACAGCTGTTC CTCTCCTGGT GCCGTTCACC CTCAACTTTA CCATCACCAA
 51 TCTGCAGTAT GGGGAGGACA TGCGTCACCC TGGCTCCAGG AAGTTCAACA
101 CCACAGAGAG GGTCCTGCAG GGTCTGCTTG GTCCCTTGTT CAAGAACTCC
151 AGTGTCGGCC CTCTGTACTC TGGCTGCAGA CTGATCTCTC TCAGGTCTGA
201 GAAGGATGGG GCAGCCACTG GAGTGGATGC CATCTGCACC CACCACCTTA
251 ACCCTCAAAG CCCTGGACTG GACAGGGAGC AGCTGTACTG GCAGCTGAGC
301 CAGATGACCA ATGGCATCAA AGAGCTGGGC CCCTACACCC TGGACCGGAA
351 CAGTCTCTAC GTCAATGGTT TCACCCATCG GAGCTCTGGG CTCACCACCA
401 GCACTCCTTG GACTTCCACA GTTGACCTTG GAACCTCAGG GACTCCATCC
451 CCCGTCCCCA GCCCCACA
```

(SEQ ID NO: 91)
```
  1 ACTGCTGGCC CTCTCCTGGT GCCATTCACC CTCAACTTCA CCATCACCAA
 51 CCTGCAGTAT GAGGAGGACA TGCATCGCCC TGGATCTAGG AAGTTCAACA
101 CCACAGAGAG GGTCCTGCAG GGTCTGCTTA GTCCCATTTT CAAGAACTCC
151 AGTGTTGGCC CTCTGTACTC TGGCTGCAGA CTGACCTCTC TCAGGCCCGA
201 GAAGGATGGG GCAGCAACTG GAATGGATGC TGTCTGCCTC TACCACCCTA
251 ATCCCAAAAG ACCTGGACTG GACAGAGAGC AGCTGTACTG GGAGCTAAGC
301 CAGCTGACCC ACAACATCAC TGAGCTGGGC CCCTACAGCC TGGACAGGGA
351 CAGTCTCTAT GTCAATGGTT TCACCCATCA GAACTCTGTG CCCACCACCA
401 GTACTCCTGG GACCTCCACA GTGTACTGGG CAACCACTGG GACTCCATCC
451 TCCTTCCCCG GCCACACA
```

(SEQ ID NO: 92)
```
  1 GAGCCTGGCC CTCTCCTGAT ACCATTCACT TTCAACTTTA CCATCACCAA
 51 CCTGCATTAT GAGGAAAACA TGCAACACCC TGGTTCCAGG AAGTTCAACA
101 CCACGGAGAG GGTTCTGCAG GGTCTGCTCA AGCCCTTGTT CAAGAACACC
```

TABLE 15-continued

CA125 Repeat Nucleotide Sequence
(SEQ ID NO: 83 thru SEQ ID NO: 145)

```
151 AGTGTTGGCC CTCTGTACTC TGGCTGCAGA CTGACCTCTC TCAGGCCCGA
201 GAAGGATGGG GCAGCAACTG GAATGGATGC TGTCTGCCTC TACCACCCTA
251 ATCCCAAAAG ACCTGGGCTG GACAGAGAGC AGCTGTACTG GGAGCTAAGC
301 CAGCTGACCC ACAACATCAC TGAGCTGGGC CCCTACAGCC TGGACAGGGA
351 CAGTCTCTAT GTCAATGGTT TCACCCATCA GAACTCTGTG CCCACCACCA
401 GTACTCCTGG GACCTCCACA GTGTACTGGG CAACCACTGG GACTCCATCC
451 TCCTTCCCCG GCCACACA
```

(SEQ ID NO: 93)
```
  1 GAGCCTGGCC CTCTCCTGAT ACCATTCACT TTCAACTTTA CCATCACCAA
 51 CCTGCATTAT GAGGAAAACA TGCAACACCC TGGTTCCAGG AAGTTCAACA
101 CCACGGAGAG GGTTCTGCAG GGTCTGCTCA AGCCCTTGTT CAAGAACACC
151 AGTGTTGGCC CTCTGTACTC TGGCTGCAGA CTGACCTTGC TCAGACCTGA
201 GAAGCATGAG GCAGCCACTG GAGTGGACAC CATCTGTACC CACCGCGTTG
251 ATCCCATCGG ACCTGGACTG GACAGGGAGC GGCTATACTG GGAGCTGAGC
301 CAGCTGACCA ACAGCATTAC CGAACTGGGA CCCTACACCC TGGACAGGGA
351 CAGTCTCTAT GTCAATGGCT TCAACCCTCG GAGCTCTGTG CCAACCACCA
401 GCACTCCTGG GACCTCCACA GTGCACCTGG CAACCTCTGG GACTCCATCC
451 TCCCTGCCTG GCCACACA
```

(SEQ ID NO: 94)
```
  1 GCCCCTGTCC CTCTCTTGAT ACCATTCACC CTCAACTTTA CCATCACCAA
 51 CCTGCATTAT GAGGAAAACA TGCAACACCC TGGTTCCAGG AAGTTCAACA
101 CCACGGAGAG GGTTCTGCAG GGTCTGCTCA AGCCCTTGTT CAAGAACACC
151 AGTGTTGGCC CTCTGTACTC TGGCTGCAGA CTGACCTTGC TCAGACCTGA
201 GAAGCATGAG GCAGCCACTG GAGTGGACAC CATCTGTACC CACCGCGTTG
251 ATCCCATCGG ACCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCN GANCTCTGNG CCCACCACCA
401 GCACTCCTGG GACCTCCACA GTGNACNTNG GNACCTCNGG GACTCCATCC
451 TCCNTCCCCN GCCNCACA
```

(SEQ ID NO: 95)
```
  1 TCTGCTGGCC CTCTCCTGGT GCCATTCACC CTCAACTTCA CCATCACCAA
 51 CCTGCAGTAC GAGGAGGACA TGCATCACCC AGGCTCCAGG AAGTTCAACA
101 CCACGGAGCG GGTCCTGCAG GGTCTGCTTG GTCCCATGTT CAAGAACACC
151 AGTGTCGGCC TTCTGTACTC TGGCTGCAGA CTGACCTTGC TCAGGCCTGA
201 GAAGAATGGG GCAGCCACTG GAATGGATGC CATCTGCAGC CACCGTCTTG
251 ACCCCAAAAG CCCTGGACTC GACAGAGAGC AGCTGTACTG GGAGCTGAGC
301 CAGCTGACCC ATGGCATCAA AGAGCTGGGC CCCTACACCC TGGACAGGAA
351 CAGTCTCTAT GTCAATGGTT TCACCCATCG GAGCTCTGTG CCCCCACCA
401 GCACTCCTGG GACCTCCACA GTGGACCTTG GAACCTCAGG GACTCCATCC
451 TCCCTCCCCA GCCCCACA
```

TABLE 15-continued

CA125 Repeat Nucleotide Sequence
(SEQ ID NO: 83 thru SEQ ID NO: 145)

(SEQ ID NO: 96)
```
  1 ACAGCTGTTC CTCTCCTGGT GCCGTTCACC CTCAACTTTA CCATCACCAA
 51 TCTGCAGTAT GGGGAGGACA TGCGTCACCC TGGCTCCAGG AAGTTCAACA
101 CCACAGAGAG GGTCCTGCAG GTCTGCTTG GTCCCTTGTT CAAGAACTCC
151 AGTGTCGGCC CTCTGTACTC TGGCTGCAGA CTGATCTCTC TCAGGTCTGA
201 GAAGGATGGG GCAGCCACTG GAGTGGATGC CATCTGCACC CACCACCTTA
251 ACCCTCAAAG CCCTGGACTG ACAGGGAGC AGCTGTACTG GCAGCTGAGC
301 CAGATGACCA ATGGCATCAA AGAGCTGGGC CCCTACACCC TGGACCGGAA
351 CAGTCTCTAC GTCAATGGTT TCACCCATCG GAGCTCTGGG CTCACCACCA
401 GCACTCCTTG GACTTCCACA GTTGACCTTG AACCTCAGG GACTCCATCC
451 CCCGTCCCCA GCCCCACA
```

(SEQ ID NO: 97)
```
  1 ACTGCTGGCC CTCTCCTGGT GCCATTCACC CTAAACTTCA CCATCACCAA
 51 CCTGCAGTAT GAGGAGGACA TGCATCGCCC TGGATCTAGG AAGTTCAACG
101 CCACAGAGAG GGTCCTGCAG GTCTGCTTA GTCCCATATT CAAGAACTCC
151 AGTGTTGGCC CTCTGTACTC TGGCTGCAGA CTGACCTCTC TCAGGCCCGA
201 GAAGGATGGG GCAGCAACTG GAATGGATGC TGTCTGCCTC TACCACCCTA
251 ATCCCAAAAG ACCTGGACTG ACAGAGAGC AGCTGTACTG GGAGCTAAGC
301 CAGCTGACCC ACAACATCAC TGAGCTGGGC CCCTACAGCC TGGACAGGGA
351 CAGTCTCTAT GTCAATGGTT TCACCCATCA GAGCTCTATG ACGACCACA
401 GAACTCCTGA TACCTCCACA ATGCACCTGG CAACCTCGAG AACTCCAGCC
451 TCCCTGTCTG GACCTACG
```

(SEQ ID NO: 98)
```
  1 ACCGCCAGCC CTCTCCTGGT GCTATTCACA ATCAACTGCA CCATCACCAA
 51 CCTGCAGTAC GAGGAGGACA TGCGTCGCAC TGGCTCCAGG AAGTTCAACA
101 CCATGGAGAG TGTCCTGCAG GTCTGCTCA AGCCCTTGTT CAAGAACACC
151 AGTGTTGGCC CTCTGTACTC TGGCTGCAGA TTGACCTTGC TCAGGCCCAA
201 GAAAGATGGG GCAGCCACTG GAGTGGATGC CATCTGCACC CACCGCCTTG
251 ATCCCAAAAG CCCTGGACTC AACAGGGAGC AGCTGTACTG GGAGCTAAGC
301 AAACTGACCA ATGACATTGA AGAGCTGGGC CCCTACACCC TGGACAGGAA
351 CAGTCTCTAT GTCAATGGTT TCACCCATCA GAGCTCTGTG TCCACCACCA
401 GCACTCCTGG GACCTCCACA GTGGATCTCA GAACCTCAGG GACTCCATCC
451 TCCCTCTCCA GCCCCACAAT TATG
```

(SEQ ID NO: 99)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGAG GGTCCTACAG GTCTGCTCA GGCCCTTGTT CAAGAACACC
151 AGTGTCAGCT CTCTGTACTC TGGTTGCAGA CTGACCTTGC TCAGGCCTGA
201 GAAGGATGGG GCAGCCACCA GAGTGGATGC TGCCTGCACC TACCGCCCTG
251 ATCCCAAAAG CCCTGGACTG GACAGAGAGC AACTATACTG GGAGCTGAGC
```

TABLE 15-continued

CA125 Repeat Nucleotide Sequence
(SEQ ID NO: 83 thru SEQ ID NO: 145)

```
301 CAGCTAACCC ACAGCATCAC TGAGCTGGGA CCCTACACCC TGGACAGGGT

351 CAGTCTCTAT GTCAATGGCT TCAACCCTCG GAGCTCTGTG CCAACCACCA

401 GCACTCCTGG GACCTCCACA GTGCACCTGG CAACCTCTGG GACTCCATCC

451 TCCCTGCCTG GCCACACA
```

(SEQ ID NO: 100)
```
  1 GCCCCTGTCC CTCTCTTGAT ACCATTCACC CTCAACTTTA CCATCACCAA

51 CCTGCATTAT GAAGAAAACA TGCAACACCC TGGTTCCAGG AAGTTCAACA

101 CCACGGAGAG GGTTCTGCAG GGTCTGCTCA AGCCCTTGTT CAAGAGCACC

151 AGCGTTGGCC CTCTGTACTC TGGCTGCAGA CTGACCTTGC TCAGACCTGA

201 GAAACATGGG GCAGCCACTG GAGTGGACGC CATCTGCACC CTCCGCCTTG

251 ATCCCACTGG TCCTGGACTG GACAGAGAGG GGCTATACTG GGAGCTGAGC

301 CAGCTGACCA ACAGCGTTAC AGAGCTGGGC CCCTACACCC TGGACAGGGA

351 CAGTCTCTAT GTCAATGGCT TCACCCAGCG GAGCTCTGTG CCAACCACCA

401 GTATTCCTGG GACCTCTGCA GTGCACCTGG AAACCTCTGG GACTCCAGCC

451 TCCCTCCCTG GCCACACA
```

(SEQ ID NO: 101)
```
  1 GCCCCTGGCC CTCTCCTGGT GCCATTCACC CTCAACTTCA CTATCACCAA

51 CCTGCAGTAT GAGGTGGACA TGCGTCACCC TGGTTCCAGG AAGTTCAACA

101 CCACGGAGAG AGTCCTGCAG GGTCTGCTCA AGCCCTTGTT CAAGAGCACC

151 AGTGTTGGCC CTCTGTACTC TGGCTGCAGA CTGACCTTGC TCAGGCCTGA

201 AAAACGTGGG GCAGCCACCG GCGTGGACAC CATCTGCACT CACCGCCTTG

251 ACCCTCTAAA CCCTGGACTG GACAGAGAGG AGCTATACTG GGAGCTGAGC

301 AAACTGACCC GTGGCATCAT CGAGCTGGGC CCCTACCTCC TGGACAGAGG

351 CAGTCTCTAT GTCAATGGTT TCACCCATCG GAACTTTGTG CCCATCACCA

401 GCACTCCTGG GACCTCCACA GTACACCTAG AACCTCTGA AACTCCATCC

451 TCCCTACCTA GACCCATA
```

(SEQ ID NO: 102)
```
  1 GTGCCTGGCC CTCTCCTGGT GCCATTCACC CTCAACTTCA CCATCACCAA

51 CTTGCAGTAT GAGGAGGCCA TGCGACACCC TGGCTCCAGG AAGTTCAATA

101 CCACGGAGAG GGTCCTACAG GGTCTGCTCA GGCCCTTGTT CAAGAATACC

151 AGTATCGGCC CTCTGTACTC CAGCTGCAGA CTGACCTTGC TCAGGCCAGA

201 GAAGGACAAG GCAGCCACCA GAGTGGATGC CATCTGTACC CACCACCCTG

251 ACCCTCAAAG CCCTGGACTG AACAGAGAGC AGCTGTACTG GGAGCTGAGC

301 CAGCTGACCC ACGGCATCAC TGAGCTGGGC CCCTACACCC TGGACAGGGA

351 CAGTCTCTAT GTCGATGGTT TCACTCATTG GAGCCCCATA CCGACCACCA

401 GCACTCCTGG GACCTCCATA GTGAACCTGG AACCTCTGG GATCCCACCT

451 TCCCTCCCTG AAACTACA
```

(SEQ ID NO: 103)
```
  1 NCNNCTGNCC CTCTCCTGNT NCCNTTCACC NTCAACTTNA CCATCACCAA

51 CCTGCANTAN GNGGANNACA TGCNNCNCCC NGGNTCCAGG AAGTTCAACA

101 CCACNGAGAG GGTTCTGCAG GGTCTGCTCA AACCCTTGTT CAGGAATAGC
```

TABLE 15-continued

CA125 Repeat Nucleotide Sequence
(SEQ ID NO: 83 thru SEQ ID NO: 145)

```
151 AGTCTGGAAT ACCTCTATTC AGGCTGCAGA CTAGCCTCAC TCAGGCCAGA
201 GAAGGATAGC TCAGCCATGG CAGTGGATGC CATCTGCACA CATCGCCCTG
251 ACCCTGAAGA CCTCGGACTG GACAGAGAGC GACTGTACTG GGAGCTGAGC
301 AATCTGACAA ATGGCATCCA GGAGCTGGGC CCCTACACCC TGGACCGGAA
351 CAGTCTCTAC GTCAATGGTT TCACCCATCG GAGCTCTGGG CTCACCACCA
401 GCACTCCTTG GACTTCCACA GTTGACCTTG GAACCTCAGG GACTCCATCC
451 CCCGTCCCCA GCCCCACA
```

(SEQ ID NO: 104)
```
  1 AGTGTTGGCC CTCTCCTGGT GCCATTCACC CTCAACTTCA CCATCACCAA
 51 CCTGCAGTAT GAGGAGGACA TGCATCGCCC TGGTTCCAGG AGGTTCAACA
101 CCACGGAGAG GGTTCTGCAG GGTCTGCTCA CGCCCTTGTT CAAGAGCACC
151 AGTGTTGGCC CTCTGTACTC TGGCTGCAGA CTGACCTTGC TCAGACCTGA
201 GAAGCAAGAG GCAGCCACTG GAGTGGACAC CATCTGTACC CACCGCGTTG
251 ATCCCATCGG ACCTGGACTG GACAGAGAGC GGCTATACTG GGAGCTGAGC
301 CAGCTGACCA ACAGCATCAC AGAGCTGGGA CCCTACACCC TGGATAGGGA
351 CAGTCTCTAT GTCAATGGCT TCAACCCTTG GAGCTCTGTG CCAACCACCA
401 GCACTCCTGG GACCTCCACA GTGCACCTGG CAACCTCTGG GACTCCATCC
451 TCCCTGCCTG GCCACACA
```

(SEQ ID NO: 105)
```
  1 GCCCCTGTCC CTCTCTTGAT ACCATTCACC CTCAACTTTA CCATCACCGA
 51 CCTGCATTAT GAAGAAAACA TGCAACACCC TGGTTCCAGG AAGTTCAACA
101 CCACGGAGAG GGTTCTGCAG GGTCTGCTCA AGCCCTTGTT CAAGAGCACC
151 AGCGTTGGCC CTCTGTACTC TGGCTGCAGA CTGACCTTGC TCAGACCTGA
201 GAAACATGGG GCAGCCACTG GAGTGGACGC CATCTGCACC CTCCGCCTTG
251 ATCCCACTGG TCCTGGACTG GACAGAGAGC GGCTATACTG GGAGCTGAGC
301 CAGCTGACCA ACAGCGTTAC AGAGCTGGGC CCCTACACCC TGGACAGGGA
351 CAGTCTCTAT GTCAATGGCT TCACCCATCG GAGCTCTGTG CCAACCACCA
401 GTATTCCTGG GACCTCTGCA GTGCACCTGG AAACCTCTGG GACTCCAGCC
451 TCCCTCCCTG GCCACACA
```

(SEQ ID NO: 106)
```
  1 GCCCCTGGCC CTCTCCTGGT GCCATTCACC CTCAACTTCA CTATCACCAA
 51 CCTGCAGTAT GAGGAGGACA TGCGTCACCC TGGTTCCAGG AAGTTCAGCA
101 CCACGGAGAG AGTCCTGCAG GGTCTGCTCA AGCCCTTGTT CAAGAACACC
151 AGTGTCAGCT CTCTGTACTC TGGTTGCAGA CTGACCTTGC TCAGGCCTGA
201 GAAGGATGGG GCAGCCACCA GAGTGGATGC TGTCTGCACC CATCGTCCTG
251 ACCCCAAAAG CCCTGGACTG GACAGAGAGC GGCTGTACTG GAAGCTGAGC
301 CAGCTGACCC ACGGCATCAC TGAGCTGGGC CCCTACACCC TGGACAGGCA
351 CAGTCTCTAT GTCAATGGTT TCACCCATCA GAGCTCTATG ACGACCACCA
401 GAACTCCTGA TACCTCCACA ATGCACCTGG CAACCTCGAG AACTCCAGCC
451 TCCCTGTCTG GACCTACG
```

TABLE 15-continued

CA125 Repeat Nucleotide Sequence
(SEQ ID NO: 83 thru SEQ ID NO: 145)

(SEQ ID NO: 107)
```
  1 ACCGCCAGCC CTCTCCTGGT GCTATTCACA ATTAACTTCA CCATCACTAA
 51 CCTGCGGTAT GAGGAGAACA TGCATCACCC TGGCTCTAGA AAGTTTAACA
101 CCACGGAGAG AGTCCTTCAG GGTCTGCTCA GGCCTGTGTT CAAGAACACC
151 AGTGTTGGCC CTCTGTACTC TGGCTGCAGA CTGACCACGC TCAGGCCCAA
201 GAAGGATGGG GCAGCCACCA AAGTGGATGC CATCTGCACC TACCGCCCTG
251 ATCCCAAAAG CCCTGGACTG GACAGAGAGC AGCTATACTG GGAGCTGAGC
301 CAGCTAACCC ACAGCATCAC TGAGCTGGGC CCCTACACCC AGGACAGGGA
351 CAGTCTCTAT GTCAATGGCT TCACCCATCG GAGCTCTGTG CCAACCACCA
401 GTATTCCTGG GACCTCTGCA GTGCACCTGG AAACCTCTGG GACTCCAGCC
451 TCCCTCCCTG GCCACACA
```

(SEQ ID NO: 108)
```
  1 GCCCCTGGCC CTCTCCTGGT GCCATTCACC CTCAACTTCA CTATCACCAA
 51 CCTGCAGTAT GAGGAGGACA TGCGTCACCC TGGTTCCAGG AAGTTCAACA
101 CCACGGAGAG AGTCCTGCAG GGTCTGCTCA AGCCCTTGTT CAAGAGCACC
151 AGTGTTGGCC CTCTGTACTC TGGCTGCAGA CTGACCTTGC TCAGGCCTGA
201 AAAACGTGGG GCAGCCACCG GCGTGGACAC CATCTGCACT CACCGCCTTG
251 ACCCTCTAAA CCCAGGACTG GACAGAGAGC AGCTATACTG GGAGCTGAGC
301 AAACTGACCC GTGGCATCAT CGAGCTGGGC CCCTACCTCC TGGACAGAGG
351 CAGTCTCTAT GTCAATGGTT TCACCCATCG GACCTCTGTG CCCACCACCA
401 GCACTCCTGG GACCTCCACA GTGGACCTTG GAACCTCAGG GACTCCATTC
451 TCCCTCCCAA GCCCCGCA
```

(SEQ ID NO: 109)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGAG GGTCCTGCAG ACTCTGCTTG GTCCTATGTT CAAGAACACC
151 AGTGTTGGCC TTCTGTACTC TGGCTGCAGA CTGACCTTGC TCAGGTCCGA
201 GAAGGATGGA GCAGCCACTG GAGTGGATGC CATCTGCACC CACCGTCTTG
251 ACCCCAAAAG CCCTGGAGTG GACAGGGAGC AACTATACTG GGAGCTGAGC
301 CAGCTGACCA ATGGCATTAA AGAACTGGGC CCCTACACCC TGGACAGGAA
351 CAGTCTCTAT GTCAATGGGT TCACCCATTG GATCCCTGTG CCCACCAGCA
401 GCACTCCTGG GACCTCCACA GTGGACCTTG GGTCAGGGAC TCCATCCTCC
451 CTCCCCAGCC CCACA
```

(SEQ ID NO: 110)
```
  1 ACTGCTGGCC CTCTCCTGGT GCCGTTCACC CTCAACTTCA CCATCACCAA
 51 CCTGAAGTAC GAGGAGGACA TGCATTGCCC TGGCTCCAGG AAGTTCAACA
101 CCACAGAGAG AGTCCTGCAG AGTCTGCTTG GTCCCATGTT CAAGAACACC
151 AGTGTTGGCC CTCTGTACTC TGGCTGCAGA CTGACCTTGC TCAGGTCCGA
201 GAAGGATGGA GCAGCCACTG GAGTGGATGC CATCTGCACC CACCGTCTTG
251 ACCCCAAAAG CCCTGGAGTG GACAGGGAGC AGCTATACTG GGAGCTGAGC
```

TABLE 15-continued

CA125 Repeat Nucleotide Sequence
(SEQ ID NO: 83 thru SEQ ID NO: 145)

```
301 CAGCTGACCA ATGGCATCAA AGAGCTGGGT CCCTACACCC TGGACAGAAA
351 CAGTCTCTAT GTCAATGGTT TCACCCATCA GACCTCTGCG CCCAACACCA
401 GCACTCCTGG GACCTCCACA GTGGACCTTG GGACCTCAGG GACTCCATCC
451 TCCCTCCCCA GCCCTACA
```

(SEQ ID NO: 111)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGNG NGTNCTGCAG GGTCTGCTNN NNCCCNTNTT CAAGAACNCC
151 AGTGTNGGCC NTCTGTACTC TGGCTGCAGA CTGACCTNNC TCAGGNCNGA
201 GAAGNATGGN GCAGCCACTG GANTGGATGC CATCTGCANC CACCNNCNTN
251 ANCCCAAAAG NCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATTG GATCCCTGTG CCCACCAGCA
401 GCACTCCTGG GACCTCCACA GTGGACCTTG GGTCAGGGAC TCCATCCTCC
451 CTCCCCAGCC CCACA
```

(SEQ ID NO: 112)
```
  1 ACTGCTGGCC CTCTCCTGGT GCCGTTCACC CTCAACTTCA CCATCACCAA
 51 CCTGAAGTAC GAGGAGGACA TGCATTGCCC TGGCTCCAGG AAGTTCAACA
101 CCACAGAGAG AGTCCTGCAG AGTCTGCTTG GTCCCATGTT CAAGAACACC
151 AGTGTTGGCC CTCTGTACTC TGGCTGCAGA CTGACCTCGC TCAGGTCCGA
201 GAAGGATGGA GCAGCCACTG GAGTGGATGC CATCTGCACC CACCGTGTTG
251 ANCCCAAAAG CCCTGGAGTG ACAGGGAGC AGCTATACTG GGAGCTGAGC
301 CAGCTGACCA ATGGCATCAA AGAGCTGGGT CCCTACACCC TGGACAGAAA
351 CAGTCTCTAT GTCAATGGTT TCACCCATCA GACCTCTGCG CCCAACACCA
401 GCACTCCTGG GACCTCCACA GTGNACNTNG GNACCTCNGG GACTCCATCC
451 TCCNTCCCCN GCCNCACA
```

(SEQ ID NO: 113)
```
  1 TCTGCTGGCC CTCTCCTGGT GCCATTCACC CTCAACTTCA CCATCACCAA
 51 CCTGCAGTAC GAGGAGGACA TGCATCACCC AGGCTCCAGG AAGTTCAACA
101 CCACGGAGCG GGTCCTGCAG GGTCTGCTTG GTCCCATGTT CAAGAACACC
151 AGTGTCGGCC TTCTGTACTC TGGCTGCAGA CTGACCTTGC TCAGGCCTGA
201 GAAGAATGGG GCAACCACTG GAATGGATGC CATCTGCACC CACCGTCTTG
251 ACCCCAAAAG CCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCN GANCTCTGNG CCCACCACCA
401 GCACTCCTGG GACCTCCACA GTGNACNTNG GNACCTCNGG GACTCCATCC
451 TCCNTCCCCN GCCNCACA
```

(SEQ ID NO: 114)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGAG GGTTCTGCAG GGTCTGCTCA AACCCTTGTT CAGGAATAGC
```

TABLE 15-continued

CA125 Repeat Nucleotide Sequence
(SEQ ID NO: 83 thru SEQ ID NO: 145)

```
151 AGTCTGGAAT ACCTCTATTC AGGCTGCAGA CTAGCCTCAC TCAGGCCAGA
201 GAAGGATAGC TCAGCCATGG CAGTGGATGC CATCTGCACA CATCGCCCTG
251 ACCCTGAAGA CCTCGGACTG GACAGAGAGC GACTGTACTG GGAGCTGAGC
301 AATCTGACAA ATGGCATCCA GGAGCTGGGC CCCTACACCC TGGACCGGAA
351 CAGTCTCTAT GTCAATGGTT TCACCCATCG AAGCTCTATG CCCACCACCA
401 GCACTCCTGG GACCTCCACA GTGGATGTGG AACCTCAGG GACTCCATCC
451 TCCAGCCCCA GCCCCACG
```

(SEQ ID NO: 115)
```
  1 ACTGCTGGCC CTCTCCTGAT ACCATTCACC CTCAACTTCA CCATCACCAA
 51 CCTGCAGTAT GGGGAGGACA TGGGTCACCC TGGCTCCAGG AAGTTCAACA
101 CCACAGAGAG GGTCCTGCAG GGTCTGCTTG GTCCCATATT CAAGAACACC
151 AGTGTTGGCC CTCTGTACTC TGGCTGCAGA CTGACCTCTC TCAGGTCTGA
201 GAAGGATGGA GCAGCCACTG GAGTGGATGC CATCTGCATC CATCATCTTG
251 ACCCCAAAAG CCCTGGACTC AACAGAGAGC GGCTGTACTG GGAGCTGAGC
301 CAACTGACCA ATGGCATCAA AGAGCTGGGC CCCTACACCC TGGACAGGAA
351 CAGTCTCTAT GTCAATGGTT TCACCCATCG GACCTCTGTG CCCACCACCA
401 GCACTCCTGG GACCTCCACA GTGGACCTTG AACCTCAGG GACTCCATTC
451 TCCCTCCCAA GCCCCGCA
```

(SEQ ID NO: 116)
```
  1 ACTGCTGGCC CTCTCCTGGT GCTGTTCACC CTCAACTTCA CCATCACCAA
 51 CCTGAAGTAT GAGGAGGACA TGCATCGCCC TGGCTCCAGG AAGTTCAACA
101 CCACTGAGAG GGTCCTGCAG ACTCTGCTTG GTCCTATGTT CAAGAACACC
151 AGTGTTGGCC TTCTGTACTC TGGCTGCAGA CTGACCTTGC TCAGGTCCGA
201 GAAGGATGGA GCAGCCACTG GAGTGGATGC CATCTGCACC CACCGTCTTG
251 ACCCCAAAAG CCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCN GANCTCTGNG CCCACCACCA
401 GCACTCCTGG GACCTCCACA GTGNACNTNG GNACCTCNGG GACTCCATCC
451 TCCNTCCCCN GCCNCACA
```

(SEQ ID NO: 117)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGAG AGTCCTTCAG GGTCTGCTCA GGCCTGTGTT CAAGAACACC
151 AGTGTTGGCC CTCTGTACTC TGGCTGCAGA CTGACCTTGC TCAGGCCCAA
201 GAAGGATGGG GCAGCCACCA AAGTGGATGC CATCTGCACC TACCGCCCTG
251 ATCCCAAAAG CCCTGGACTG GACAGAGAGC AGCTATACTG GGAGCTGAGC
301 CAGCTAACCC ACAGCATCAC TGAGCTGGGC CCCTACACCC AGGACAGGGA
351 CAGTCTCTAT GTCAATGGCT TCACCCATCG GAGCTCTGTG CCAACCACCA
401 GTATTCCTGG GACCTCTGCA GTGCACCTGG AAACCACTGG GACTCCATCC
451 TCCTTCCCCG GCCACACA
```

TABLE 15-continued

CA125 Repeat Nucleotide Sequence
(SEQ ID NO: 83 thru SEQ ID NO: 145)

(SEQ ID NO: 118)
```
  1 GAGCCTGGCC CTCTCCTGAT ACCATTCACT TTCAACTTTA CCATCACCAA
 51 CCTGCGTTAT GAGGAAAACA TGCAACACCC TGGTTCCAGG AAGTTCAACA
101 CCACGGAGAG GGTTCTGCAG GGTCTGCTCA CGCCCTTGTT CAAGAACACC
151 AGTGTTGGCC CTCTGTACTC TGGCTGCAGA CTGACCTTGC TCAGACCTGA
201 GAAGCAGGAG GCAGCCACTG GAGTGGACAC CATCTGTACC CACCGCGTTG
251 ATCCCATCGG ACCTGGACTG GACAGAGAGC GGCTATACTG GGAGCTGAGC
301 CAGCTGACCA ACAGCATCAC AGAGCTGGGA CCCTACACCC TGGATAGGGA
351 CAGTCTCTAT GTCGATGGCT TCAACCCTTG GAGCTCTGTG CCAACCACCA
401 GCACTCCTGG GACCTCCACA GTGCACCTGG CAACCTCTGG GACTCCATCC
451 CCCCTGCCTG GCCACACA
```

(SEQ ID NO: 119)
```
  1 GCCCCTGTCC CTCTCTTGAT ACCATTCACC CTCAACTTTA CCATCACCGA
 51 CCTGCATTAT GAAGAAAACA TGCAACACCC TGGTTCCAGG AAGTTCAACA
101 CCACGGAGAG GGTTCTGCAG GGTCTGCTCA AGCCCTTGTT CAAGAGCACC
151 AGCGTTGGCC CTCTGTACTC TGGCTGCAGA CTGACCTTGC TCAGACCTGA
201 GAAACATGGG GCAGCCACTG GAGTGGACGC CATCTGCACC CTCCGCCTTG
251 ATCCCACTGG TCCTGGACTG GACAGAGAGC GGCTATACTG GGAGCTGAGC
301 CAGCTGACCA ACAGCATCAC AGAGCTGGGA CCCTACACCC TGGATAGGGA
351 CAGTCTCTAT GTCAATGGCT TCAACCCTTG GAGCTCTGTG CCAACCACCA
401 GCACTCCTGG GACCTCCACA GTGCACCTGG CAACCTCTGG GACTCCATCC
451 TCCCTGCCTG GCCACACA
```

(SEQ ID NO: 120)
```
  1 ACTGCTGGCC CTCTCCTGGT GCCGTTCACC CTCAACTTTA CCATCACCAA
 51 CCTGAAGTAC GAGGAGGACA TGCATTGCCC TGGCTCCAGG AAGTTCAACA
101 CCACAGAGAG AGTCCTGCAG AGTCTGCATG GTCCCATGTT CAAGAACACC
151 AGTGTTGGCC CTCTGTACTC TGGCTGCAGA CTGACCTTGC TCAGGTCCGA
201 GAAGGATGGA GCAGCCACTG GAGTGGATGC CATCTGCACC CACCGTCTTG
251 ANCCCAAAAG CCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCN GANCTCTGNG CCCACCACCA
401 GCACTCCTGG GACCTCCACA GTGNACNTNG GNACCTCNGG GACTCCATCC
451 TCCNTCCCCN GCCNCACA
```

(SEQ ID NO: 121)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGNG NGTNCTGCAG GGTCTGCTNN NNCCCNTNTT CAAGAACNCC
151 AGTGTNGGCC NTCTGTACTC TGGCTGCAGA CTGACCTNNC TCAGGNCNGA
201 GAAGNATGGN GCAGCCACTG GANTGGATGC CATCTGCANC CACCNNCNTN
251 ANCCCAAAAG NCCTGGACTG NACAGNGAGC NGCTNTACTG GGAGCTNAGC
```

TABLE 15-continued

CA125 Repeat Nucleotide Sequence
(SEQ ID NO: 83 thru SEQ ID NO: 145)

```
301 CANCTGACCA ACAGCATCAC AGAGCTGGGA CCCTACACCC TGGATAGGGA

351 CAGTCTCTAT GTCAATGGTT TCACCCATCG AAGCTCTATG CCCACCACCA

401 GTATTCCTGG GACCTCTGCA GTGCACCTGG AAACCTCTGG GACTCCAGCC

451 TCCCTCCCTG GCCACACA
```

(SEQ ID NO: 122)
```
  1 GCCCCTGGCC CTCTCCTGGT GCCATTCACC CTCAACTTCA CTATCACCAA

51 CCTGCAGTAT GAGGAGGACA TGCGTCACCC TGGTTCCAGG AAGTTCAACA

101 CCACGGAGAG AGTCCTGCAG GGTCTGCTCA AGCCCTTGTT CAAGAGCACC

151 AGTGTTGGCC CTCTGTACTC TGGCTGCAGA CTGACCTTGC TCAGGCCTGA

201 AAAACGTGGG GCAGCCACCG GCGTGGACAC CATCTGCACT CACCGCCTTG

251 ACCCTCTAAA CCCTGGACTG NACAGNGAGC NGCTNTACTG GGAGCTNAGC

301 CANCTGACCA ANNNCATCNN NGAGCTGGGN CCCTACACCC TGGACAGGNA

351 CAGTCTCTAT GTCAATGGTT TCACCCATCN GANCTCTGNG CCCACCACCA

401 GCACTCCTGG GACCTCCACA GTGNACNTNG GNACCTCNGG GACTCCATCC

451 TCCNTCCCCN GCCNCACA
```

(SEQ ID NO: 123)
```
  1 NCNNCTGNCC CTCTCCTGNT NCCNTTCACC NTCAACTTNA CCATCACCAA

51 CCTGCANTAN GNGGANNACA TGCNNCNCCC NGGNTCCAGG AAGTTCAACA

101 CCACNGAGNG NGTNCTGCAG GGTCTGCTNN NNCCCNTNTT CAAGAACNCC

151 AGTGTNGGCC NTCTGTACTC TGGCTGCAGA CTGACCTNNC TCAGGNCNGA

201 GAAGNATGGN GCAGCCACTG GANTGGATGC CATCTGCANC CACCNNCNTN

251 ANCCCAAAAG NCCTGGACTG NACAGNGAGC NGCTNTACTG GGAGCTNAGC

301 CANCTGACCA ANNNCATCNN NGAGCTGGGN CCCTACACCC TGGACAGGNA

351 CAGTCTCTAT GTCAATGGTT TTCACCCTCG GAGCTCTGTG CCAACCACCA

401 GCACTCCTGG GACCTCCACA GTGCACCTGG CAACCTCTGG GACTCCATCC

451 TCCCTGCCTG GCCACACA
```

(SEQ ID NO: 124)
```
  1 GCCCCTGTCC CTCTCTTGAT ACCATTCACC CTCAACTTTA CCATCACCAA

51 CCTGCATTAT GAAGAAAACA TGCAACACCC TGGTTCCAGG AAGTTCAACA

101 CCACGGAGCG GGTCCTGCAG GGTCTGCTTG GTCCCATGTT CAAGAACACA

151 AGTGTCGGCC TTCTGTACTC TGGCTGCAGA CTGACCTTGC TCAGGCCTGA

201 GAAGAATGGG GCAGCCACTG GAATGGATGC CATCTGCAGC CACCGTCTTG

251 ACCCCAAAAG CCCTGGACTG NACAGNGAGC NGCTNTACTG GGAGCTNAGC

301 CANCTGACCA ANNNCATCNN NGAGCTGGGN CCCTACACCC TGGACAGGNA

351 CAGTCTCTAT GTCAATGGTT TCACCCATCN GANCTCTGNG CCCACCACCA

401 GCACTCCTGG GACCTCCACA GTGNACNTNG GNACCTCNGG GACTCCATCC

451 TCCNTCCCCN GCCNCACA
```

(SEQ ID NO: 125)
```
  1 NCNNCTGNCC CTCTCCTGNT NCCNTTCACC NTCAACTTNA CCATCACCAA

51 CCTGCANTAN GNGGANNACA TGCNNCNCCC NGGNTCCAGG AAGTTCAACA

101 CCACNGAGNG NGTNCTGCAG GGTCTGCTNN NNCCCNTNTT CAAGAACNCC
```

TABLE 15-continued

CA125 Repeat Nucleotide Sequence
(SEQ ID NO: 83 thru SEQ ID NO: 145)

```
151 AGTGTNGGCC NTCTGTACTC TGGCTGCAGA CTGACCTNNC TCAGGNCNGA
201 GAAGNATGGN GCAGCCACTG GANTGGATGC CATCTGCANC CACCNNCNTN
251 ANCCCAAAAG NCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCA GAACTCTGTG CCCACCACCA
401 GTACTCCTGG GACCTCCACA GTGTACTGGG CAACCACTGG GACTCCATCC
451 TCCTTCCCCG GCCACACA
```

(SEQ ID NO: 126)
```
  1 GAGCCTGGCC CTCTCCTGAT ACCATTCACT TTCAACTTTA CCATCACCAA
 51 CCTGCATTAT GAGGAAAACA TGCAACACCC TGGTTCCAGG AAGTTCAACA
101 CCACGGAGAG GGTTCTGCAG GGTCTGCTCA CGCCCTTGTT CAAGAACACC
151 AGTGTTGGCC CTCTGTACTC TGGCTGCAGA CTGACCTTGC TCAGACCTGA
201 GAAGCAGGAG GCAGCCACTG GAGTGGACAC CATCTGTACC CACCGCGTTG
251 ATCCCATCGG ACCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCN GANCTCTGNG CCCACCACCA
401 GCACTCCTGG GACCTCCACA GTGNACNTNG GNACCTCNGG GACTCCATCC
451 TCCNTCCCCN GCCNCACA
```

(SEQ ID NO: 127)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGNG NGTNCTGCAG GGTCTGCTNN NNCCCNTNTT CAAGAACNCC
151 AGTGTNGGCC NTCTGTACTC TGGCTGCAGA CTGACCTNNC TCAGGNCNGA
201 GAAGNATGGN GCAGCCACTG GANTGGATGC CATCTGCANC CACCNNCNTN
251 ANCCCAAAAG NCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCG GAGCTCTGTG CCAACCACCA
401 GCAGTCCTGG GACCTCCACA GTGCACCTGG CAACCTCTGG GACTCCATCC
451 TCCCTGCCTG GCCACACA
```

(SEQ ID NO: 128)
```
  1 GCCCCTGTCC CTCTCTTGAT ACCATTCACC CTCAACTTTA CCATCACCAA
 51 CCTGCATTAT GAAGAAAACA TGCAACACCC TGGTTCCAGG AAGTTCAACA
101 CCACGGAGAG GGTTCTGCAG GGTCTGCTCA AGCCCTTGTT CAAGAGCACC
151 AGTGTTGGCC CTCTGTACTC TGGCTGCAGA CTGACCTTGC TCAGACCTGA
201 GAAACATGGG GCAGCCACTG GAGTGGACGC CATCTGCACC CTCCGCCTTG
251 ATCCCACTGG TCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCN GANCTCTGNG CCCACCACCA
401 GCACTCCTGG GACCTCCACA GTGNACNTNG GNACCTCNGG GACTCCATCC
451 TCCNTCCCCN GCCNCACA
```

TABLE 15-continued

CA125 Repeat Nucleotide Sequence
(SEQ ID NO: 83 thru SEQ ID NO: 145)

(SEQ ID NO: 129)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGNG NGTNCTGCAG GGTCTGCTNN NNCCCNTNTT CAAGAACNCC
151 AGTGTNGGCC NTCTGTACTC TGGCTGCAGA CTGACCTNNC TCAGGNCNGA
201 GAAGNATGGN GCAGCCACTG GANTGGATGC CATCTGCANC CACCNNCNTN
251 ANCCCAAAAG NCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCG GACCTCTGTG CCCACCACCA
401 GCACTCCTGG GACCTCCACA GTGCACCTGG CAACCTCTGG GACTCCATCC
451 TCCCTGCCTG GCCACACA
```

(SEQ ID NO: 130)
```
  1 GCCCCTGTCC CTCTCTTGAT ACCATTCACC CTCAACTTTA CCATCACCAA
 51 CCTGCAGTAT GAGGAGGACA TGCATCGCCC TGGATCTAGG AAGTTCAACA
101 CCACAGAGAG GGTCCTGCAG GGTCTGCTTA GTCCCATTTT CAAGAACTCC
151 AGTGTTGGCC CTCTGTACTC TGGCTGCAGA CTGACCTCTC TCAGGCCCGA
201 GAAGGATGGG GCAGCAACTG GAATGGATGC TGTCTGCCTC TACCACCCTA
251 ATCCCAAAAG ACCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCN GANCTCTGNG CCCACCACCA
401 GCACTCCTGG GACCTCCACA GTGNACNTNG GNACCTCNGG GACTCCATCC
451 TCCNTCCCCN GCCNCACA
```

(SEQ ID NO: 131)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGNG NGTNCTGCAG GGTCTGCTNN NNCCCNTNTT CAAGAACNCC
151 AGTGTNGGCC NTCTGTACTC TGGCTGCAGA CTGACCTNNC TCAGGNCNGA
201 GAAGNATGGN GCAGCCACTG GANTGGATGC CATCTGCANC CACCNNCNTN
251 ANCCCAAAAG NCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATTG GAGCTCTGGG CTCACCACCA
401 GCACTCCTTG GACTTCCACA GTTGACCTTG AACCTCAGG GACTCCATCC
451 CCCGTCCCCA GCCCCACA
```

(SEQ ID NO: 132)
```
  1 ACTGCTGGCC CTCTCCTGGT GCCATTCACC CTAAACTTCA CCATCACCAA
 51 CCTGCAGTAT GAGGAGGACA TGCATCGCCC TGGATCTAGG AAGTTCAACG
101 CCACAGAGAG GGTCCTGCAG GGTCTGCTTA GTCCCATATT CAAGAACACC
151 AGTGTTGGCC CTCTGTACTC TGGCTGCAGA CTGACCTTGC TCAGACCTGA
201 GAAGCAGGAG GCAGCCACTG GAGTGGACAC CATCTGTACC CACCGCGTTG
251 ATCCCATCGG ACCTGGACTG NACAGNGAGC NGCTNTACTG GGAGCTNAGC
```

TABLE 15-continued

CA125 Repeat Nucleotide Sequence
(SEQ ID NO: 83 thru SEQ ID NO: 145)

301 CANCTGACCA ANNNCATCNN NGAGCTGGGN CCCTACACCC TGGACAGGNA

351 CAGTCTCTAT GTCAATGGTT TCACCCATCN GANCTCTGNG CCCACCACCA

401 GCACTCCTGG GACCTCCACA GTGNACNTNG GNACCTCNGG GACTCCATCC

451 TCCNTCCCCN GCCNCACA (SEQ ID NO: 133)
1 NCNNCTGNCC CTCTCCTGNT NCCNTTCACC NTCAACTTNA CCATCACCAA

51 CCTGCANTAN GNGGANNACA TGCNNCNCCC NGGNTCCAGG AAGTTCAACA

101 CCACNGAGNG NGTNCTGCAG GGTCTGCTNN NNCCCNTNTT CAAGAACNCC

151 AGTGTNGGCC NTCTGTACTC TGGCTGCAGA CTGACCTNNC TCAGGNCNGA

201 GAAGNATGGN GCAGCCACTG GANTGGATGC CATCTGCANC CACCNNCNTN

251 ANCCCAAAAG NCCTGGACTG NACAGNGAGC NGCTNTACTG GGAGCTNAGC

301 CANCTGACCA ANNNCATCNN NGAGCTGGGN CCCTACACCC TGGACAGGNA

351 CAGTCTCTAT GTCAATGGTT TCACCCATCG GAGCTTTGGG CTCACCACCA

401 GCACTCCTTG GACTTCCACA GTTGACCTTG GAACCTCAGG GACTCCATCC

451 CCCGTCCCCA GCCCCACA (SEQ ID NO: 134)
1 ACTGCTGGCC CTCTCCTGGT GCCATTCACC CTAAACTTCA CCATCACCAA

51 CCTGCAGTAT GAGGAGGACA TGCATCGCCC TGGCTCCAGG AAGTTCAACA

101 CCACGGAGAG GGTCCTTCAG GGTCTGCTTA CGCCCTTGTT CAGGAACACC

151 AGTGTCAGCT CTCTGTACTC TGGTTGCAGA CTGACCTTGC TCAGGCCTGA

201 GAAGGATGGG GCAGCCACCA GAGTGGATGC TGTCTGCACC CATCGTCCTG

251 ACCCCAAAAG CCCTGGACTG NACAGNGAGC NGCTNTACTG GGAGCTNAGC

301 CANCTGACCA ANNNCATCNN NGAGCTGGGN CCCTACACCC TGGACAGGNA

351 CAGTCTCTAT GTCAATGGTT TCACCCATCN GANCTCTGNG CCCACCACCA

401 GCACTCCTGG GACCTCCACA GTGNACNTNG GNACCTCNGG GACTCCATCC

451 TCCNTCCCCN GCCNCACA (SEQ ID NO: 135)
1 NCNNCTGNCC CTCTCCTGNT NCCNTTCACC NTCAACTTNA CCATCACCAA

51 CCTGCANTAN GNGGANNACA TGCNNCNCCC NGGNTCCAGG AAGTTCAACA

101 CCACNGAGNG NGTNCTGCAG GGTCTGCTNN NNCCCNTNTT CAAGAACNCC

151 AGTGTNGGCC NTCTGTACTC TGGCTGCAGA CTGACCTNNC TCAGGNCNGA

201 GAAGNATGGN GCAGCCACTG GANTGGATGC CATCTGCANC CACCNNCNTN

251 ANCCCAAAAG NCCTGGACTG NACAGNGAGC NGCTNTACTG GGAGCTNAGC

301 CANCTGACCA ANNNCATCNN NGAGCTGGGN CCCTACACCC TGGACAGGNA

351 CAGTCTCTAT GTCAATGGTT TCACCCATTG GATCCCTGTG CCCACCAGCA

401 GCACTCCTGG GACCTCCACA GTGGACCTTG GGTCAGGGAC TCCATCCTCC

451 CTCCCCAGCC CCACA (SEQ ID NO: 136)
1 ACTGCTGGCC CTCTCCTGGT ACCATTCACC CTCAACTTCA CCATCACCAA

51 CCTGCAGTAT GGGGAGGACA TGGGTCACCC TGGCTCCAGG AAGTTCAACA

101 CCACAGAGAG GGTCCTGCAG GGTCTGCTTG GTCCCATATT CAAGAACACC

TABLE 15-continued

CA125 Repeat Nucleotide Sequence
(SEQ ID NO: 83 thru SEQ ID NO: 145)

```
151 AGTGTTGGCC CTCTGTACTC TGGCTGCAGA CTGACCTCTC TCAGGTCCGA
201 GAAGGATGGA GCAGCCACTG GAGTGGATGC CATCTGCATC CATCATCTTG
251 ACCCCAAAAG CCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCN GANCTCTGNG CCCACCACCA
401 GCACTCCTGG GACCTCCACA GTGNACNTNG GNACCTCNGG GACTCCATCC
451 TCCNTCCCCN GCCNCACA
```

(SEQ ID NO: 137)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGNG NGTNCTGCAG GGTCTGCTNN NNCCCNTNTT CAAGAACNCC
151 AGTGTNGGCC NTCTGTACTC TGGCTGCAGA CTGACCTNNC TCAGGNCNGA
201 GAAGNATGGN GCAGCCACTG GANTGGATGC CATCTGCANC CACCNNCNTN
251 ANCCCAAAAG NCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCA GACCTTTGCG CCCAACACCA
401 GCACTCCTGG GACCTCCACA GTGGACCTTG GACCTCAGG GACTCCATCC
451 TCCCTCCCC AGCCCTACA
```

(SEQ ID NO: 138)
```
  1 TCTGCTGGCC CTCTCCTGGT GCCATTCACC CTCAACTTCA CCATCACCAA
 51 CCTGCAGTAC GAGGAGGACA TGCATCACCC AGGCTCCAGG AAGTTCAACA
101 CCACGGAGCG GGTCCTGCAG GGTCTGCTTG GTCCCATGTT CAAGAACACC
151 AGTGTCGGCC TTCTGTACTC TGGCTGCAGA CTGACCTTGC TCAGGCCTGA
201 GAAGAATGGG GCAGCCACCA GAGTGGATGC TGTCTGCACC CATCGTCCTG
251 ACCCCAAAAG CCCTGGACTG NACAGNGAGC NGCTNTACTG GGAGCTNAGC
301 CANCTGACCA ANNNCATCNN NGAGCTGGGN CCCTACACCC TGGACAGGNA
351 CAGTCTCTAT GTCAATGGTT TCACCCATCN GANCTCTGNG CCCACCACCA
401 GCACTCCTGG GACCTCCACA GTGNACNTNG GNACCTCNGG GACTCCATCC
451 TCCNTCCCCN GCCNCACA
```

(SEQ ID NO: 139)
```
  1 NCNNCTGNCC CTCTCCTGNT NCCNTTCACC NTCAACTTNA CCATCACCAA
 51 CCTGCANTAN GNGGANNACA TGCNNCNCCC NGGNTCCAGG AAGTTCAACA
101 CCACNGAGAG GGTTCTGCAG GGTCTGCTCA AGCCCTTGTT CAAGAGCACC
151 AGTGTTGGCC CTCTGTATTC TGGCTGCAGA CTGACCTTGC TCAGGCCTGA
201 GAAGGACGGA GTAGCCACCA GAGTGGACGC CATCTGCACC CACCGCCCTG
251 ACCCCAAAAT CCCTGGGCTA GACAGACAGC AGCTATACTG GGAGCTGAGC
301 CAGCTGACCC ACAGCATCAC TGAGCTGGGA CCCTACACCC TGGATAGGGA
351 CAGTCTCTAT GTCAATGGTT TCACCCAGCG GAGCTCTGTG CCCACCACCA
401 GCACTCCTGG GACTTTCACA GTACAGCCGG AAACCTCTGA GACTCCATCA
451 TCCCTCCCTG GCCCCACA
```

TABLE 15-continued

CA125 Repeat Nucleotide Sequence
(SEQ ID NO: 83 thru SEQ ID NO: 145)

(SEQ ID NO: 140)
```
  1 GCCACTGGCC CTGTCCTGCT GCCATTCACC CTCAATTTTA CCATCACTAA
 51 CCTGCAGTAT GAGGAGGACA TGCATCGCCC TGGCTCCAGG AAGTTCAACA
101 CCACGGAGAG GGTCCTTCAG GGTCTGCTTA TGCCCTTGTT CAAGAACACC
151 AGTGTCAGCT CTCTGTACTC TGGTTGCAGA CTGACCTTGC TCAGGCCTGA
201 GAAGGATGGG GCAGCCACCA GAGTGGATGC TGTCTGCACC CATCGTCCTG
251 ACCCCAAAAG CCCTGGACTG GACAGAGAGC GGCTGTACTG GAAGCTGAGC
301 CAGCTGACCC ACGGCATCAC TGAGCTGGGC CCCTACACCC TGGACAGGCA
351 CAGTCTCTAT GTCAATGGTT TCACCCATCA GAGCTCTATG ACGACCACCA
401 GAACTCCTGA TACCTCCACA ATGCACCTGG CAACCTCGAG AACTCCAGCC
451 TCCCTGTCTG GACCTACG
```

(SEQ ID NO: 141)
```
  1 ACCGCCAGCC CTCTCCTGGT GCTATTCACA ATTAACTTCA CCATCACTAA
 51 CCTGCGGTAT GAGGAGAACA TGCATCACCC TGGCTCTAGA AAGTTTAACA
101 CCACGGAGAG AGTCCTTCAG GGTCTGCTCA GGCCTGTGTT CAAGAACACC
151 AGTGTTGGCC CTCTGTACTC TGGCTGCAGA CTGACCTTGC TCAGGCCCAA
201 GAAGGATGGG GCAGCCACCA AAGTGGATGC CATCTGCACC TACCGCCCTG
251 ATCCCAAAAG CCCTGGACTG GACAGAGAGC AGCTATACTG GGAGCTGAGC
301 CAGCTAACCC ACAGCATCAC TGAGCTGGGC CCCTACACCC TGGACAGGGA
351 CAGTCTCTAT GTCAATGGTT TCACACAGCG GAGCTCTGTG CCCACCACTA
401 GCATTCCTGG ACCCCCACA GTGGACCTGG AACATCTGG GACTCCAGTT
451 TCTAAACCTG GTCCCTCG
```

(SEQ ID NO: 142)
```
  1 GCTGCCAGCC CTCTCCTGGT GCTATTCACT CTCAACTTCA CCATCACCAA
 51 CCTGCGGTAT GAGGAGAACA TGCAGCACCC TGGCTCCAGG AAGTTCAACA
101 CCACGGAGAG GGTCCTTCAG GGCCTGCTCA GGTCCCTGTT CAAGAGCACC
151 AGTGTTGGCC CTCTGTACTC TGGCTGCAGA CTGACTTTGC TCAGGCCTGA
201 AAAGGATGGG ACAGCCACTG GAGTGGATGC CATCTGCACC CACCACCCTG
251 ACCCCAAAAG CCCTAGGCTG GACAGAGAGC AGCTGTATTG GGAGCTGAGC
301 CAGCTGACCC ACAATATCAC TGAGCTGGGC CACTATGCCC TGGACAACGA
351 CAGCCTCTTT GTCAATGGTT TCACTCATCG GAGCTCTGTG TCCACCACCA
401 GCACTCCTGG ACCCCCACA GTGTATCTGG GAGCATCTAA GACTCCAGCC
451 TCGATATTTG GCCCTTCA
```

(SEQ ID NO: 143)
```
  1 GCTGCCAGCC ATCTCCTGAT ACTATTCACC CTCAACTTCA CCATCACTAA
 51 CCTGCGGTAT GAGGAGAACA TGTGGCCTGG CTCCAGGAAG TTCAACACTA
101 CAGAGAGGGT CCTTCAGGGC CTGCTAAGGC CCTTGTTCAA GAACACCAGT
151 GTTGGCCCTC TGTACTCTGG CTCCAGGCTG ACCTTGCTCA GGCCAGAGAA
201 AGATGGGAA GCCACCGGAG TGGATGCCAT CTGCACCCAC CGCCCTGACC
251 CCACAGGCCC TGGGCTGGAC AGAGAGCAGC TGTATTTGGA GCTGAGCCAG
```

TABLE 15-continued

CA125 Repeat Nucleotide Sequence
(SEQ ID NO: 83 thru SEQ ID NO: 145)

301 CTGACCCACA GCATCACTGA GCTGGGCCCC TACACACTGG ACAGGGACAG

351 TCTCTATGTC AATGGTTTCA CCCATCGGAG CTCTGTACCC ACCACCAGC (SEQ ID NO: 144)
1 ACCGGGGTGG TCAGCGAGGA GCCATTCACA CTGAACTTCA CCATCAACAA

51 CCTGCGCTAC ATGGCGGACA TGGGCCAACC CGGCTCCCTC AAGTTCAACA

101 TCACAGACAA CGTCATGAAG CACCTGCTCA GTCCTTTGTT CCAGAGGAGC

151 AGCCTGGGTG CACGGTACAC AGGCTGCAGG GTCATCGCAC TAAGGTCTGT

201 GAAGAACGGT GCTGAGACAC GGGTGGACCT CCTCTGCACC TACCTGCAGC

251 CCCTCAGCGG CCCAGGTCTG CCTATCAAGC AGGTGTTCCA TGAGCTGAGC

301 CAGCAGACCC ATGGCATCAC CCGGCTGGGC CCCTACTCTC TGGACAAAGA

351 CAGCCTCTAC CTTAACGGTT ACAATGAACC TGGTCTAGAT GAGCCTCCTA

401 CAACTCCCAA GCCAGCCACC ACATTCCTGC CTCCTCTGTC AGAAGCCACA

451 ACA (SEQ ID NO: 145)
1 GCCATGGGGT ACCACCTGAA GACCCTCACA CTCAACTTCA CCATCTCCAA

51 TCTCCAGTAT TCACCAGATA TGGGCAAGGG CTCAGCTACA TTCAACTCCA

101 CCGAGGGGGT CCTTCAGCAC CTGCTCAGAC CCTTGTTCCA GAAGAGCAGC

151 ATGGGCCCCT TCTACTTGGG TTGCCAACTG ATCTCCCTCA GGCCTGAGAA

201 GGATGGGGCA GCCACTGGTG TGGACACCAC CTGCACCTAC CACCCTGACC

251 CTGTGGGCCC CGGGCTGGAC ATACAGCAGC TTTACTGGGA GCTGAGTCAG

301 CTGACCCATG GTGTCACCCA ACTGGGCTTC TATGTCCTGG ACAGGGATAG

351 CCTCTTCATC AATGGCTATG CACCCCAGAA TTTATCAATC CGGGGCGAGT

401 ACCAGATAAA TTTCCACATT GTCAACTGGA ACCTCAGTAA TCCAGACCCC

451 ACATCCTCAG AGTAC

TABLE 16

CA125 Repeat Domains
(SEQ ID NO: 146)

1 ATVPFMVPFTLNFTITNLQYEEDMRHPGSRKFNATERELQGLLKPLFRNSSLEYLYSG<u>CRLASLRPEKDSSAMAVDAICT</u>
HRPDPEDLGLDRERLYWELSNLTNGIQELGPYTLDRNSLYVNGFTHRSSMPTTSTPGTSTVDVGTSGTPSSSPSPT

AAGPLLMPFTLNFTITNLQYEEDMRRTGSRKFNTMESVLQGLLKPLFKNTSVGPLYSG<u>CRLTLLRPEKDGAATGVPAICT</u>
HRLDPKSPGLNREQLYWELSKLTNDIEELGPYTLDRNSLYVNGFTHQSSVSTTSTPGTSTVDLRTSGTPSSLSSPTIM

AAGPLLVPFTLNFTITNLQYGEDMGHPGSRKFNTTERVLQGLLGPIFKNTSVGPLYSG<u>CRLTSLRSEKDGAATGVDAICI</u>
HHLDPKSPGLNRERLYWELSQLTNGIKELGPYTLDRNSLYVNGFTHRTSVPTSSTPGTSTVDLGTSGTPFSLPSPA

TAGPLLVLFTLNFTITNLKYEEDMHRPGSRKFNTTERVLQTLLGPMFKNTSVGLLYSG<u>CRLTLLRSEKDGAATGVDAICT</u>
HRLDPKSPGLDREQLYWELSQLTNGIKELGPYTLDRNSLYVNGFTHWIPVPTSSTPGTSTVDLG.SGTPSSLPSPT

5 AAGPLLVPFTLNFTITNLQYEEDMHHPGSRKFNTTERVLQGLLGPMFKNTSVGLLYSG<u>CRLTLLRSEKDGAATGVDAICT</u>
HRLDPKSPGVDREQLYWELSQLTNGIKELGPYTLDRNSLYWGFTHQTSAPNTSTPGTSTVDLGTSGTPSSLPSPT

SAGPLLVPFTLNFTITNLQYEEDMRHPGSRKFNTTERVLQGLLKPLFKSTSVGPLYSG<u>CRLTLLRSEKDGAATGVDAICT</u>
HRLDPKSPGVDREQLYWELSQLTNGIKELGPYTLDRNSLYVNGFTHQTSAPNTSTPGTSTVDLGTSGTPSSLPSPT

SAGPLLVPFTLNFTITNLQYEEDMHHPGSRKFNTTERVLQGLLGPMFKNTSVGLLYSG<u>CRLTLLRPEKNGAATGMDAICS</u>
HRLDPKSPGLNREQLYWELSQLTHGIKELGPYTLDRNSLYVNGFTHRSSVAPTSTPGTSTVDLGTSGTPSSLPSPT

TAVPLLVPFTLNFTITNLQYGEDMRHPGSRKFNTTERVLQGLLGPLFKNSSVGPLYSG<u>CRLISLRSEKDGAATGVDAICT</u>
HHLNPQSPGLDREQLYWQLSQMTNGIKELGPYTLDRNSLYVNGFTHRSSGLTTSTPWTSTVDLGTSGTPSPVPSPT

TABLE 16-continued

CA125 Repeat Domains
(SEQ ID NO: 146)

```
    TAGPLLVPFTLNFTITNLQYEEDMHRPGSRKFNATERVLQGLLSPIFKNSSVGPLYSGCRLTSLRPEKDGAATGMDAVCL
    YHPNPKRPGLDREQLYWELSQLTHNITELGPYSLDRDSLYVNGFTHQNSVPTTSTPGTSTVYWATTGTPSSFPGHT

10  EPGPLLIPFTFNFTITNLHYEENMQHPGSRKFNTTERVLQGLLKPLFKNTSVGPLYSGCRLTSLRPEKDGAATGMDAVCL
    YHPNPKRPGLDREQLYCELSQLTHNITELGPYSLDRDSLYVNGFTHQNSVPTTSTPGTSTVYWATTGTPSSFPGHT

EPGPLLIPFTFNFTITNLHYEENMQHPGSRKFNTTERVLQGLLKPLFKNTSVGPLYSGCRLTLLRPEKHEAATGVDTICT
    HRVDPIGPGLDRERLYWELSQLTNSITELGPYTLDRDSLYVNGFNPRSSVPTTSTPGTSTVHLATSGTPSSLPGHT

APVPLLIPFTLNFTITNLHYEENMQHPGSRKFNTTERVLQGLLKPLFKNTSVGPLYSGCRLTLLRPEKHEAATGVDTICT
    HRVDPIGPGLDREXLYWELSXLTXXIXELGPYXLDRXSLYVNGFXXXXXXXXTSTPGTSXVXLXTSGTPXXXPXXT

SAGPLLVPFTLNFTITNLQYEEDMHHPGSRKFNTTERVLQGLLGPMFKNTSVGLLYSGCRLTLLRPEKNGAATGMDAICS
    HRLDPKSPGLDREQLYWELSQLTHGIKELGPYTLDRNSLYVNGFTHRSSVAPTSTPGTSTVDLGTSGTPSSLPSPT

TAVPLLVPFTLNFTITNLQYGEDMRHPGSRKFNTTERVLQGLLGPLFKNSSVGPLYSGCRLISLRSEKDGAATGVDAICT
    HHLNPQSPGLDREQLYWQLSQMTNGIKELGPYTLDRNSLYVNGFTHRSSGLTTSTPWTSTVDLGTSGTPSPVPSPT

15  TAGPLLVPFTLNFTITNLQYEEDMHRPGSRKFNATERVLQGLLSPIFKNSSVGPLYSGCRLTSLRPEKDGAATGMDAVCL
    YHPNPKRPGLDREQLYWELSQLTHNITELGPYSLDRDSLYVNGFTHQSSMTTTRTPDTSTMHLATSRTPASLSGPT

TASPLLVLFTINCTITNLQYEEDMRRTGSRKFNTMESVLQGLLKPLFKNTSVGPLYSGCRLTLLRPKKDGAATGVDAICT
    HRLDPKSPGLNREQLYWELSKLTNDIEELGPYTLDRNSLYVNGFTHQSSVSTTSTPGTSTVDLRTSGTPSSLSSPTIM

XXXPLLXPFTLNFTITNLXYEEXMXXPGSRKFNTTERVLQGLLRPLFKNTSVSSLYSGCRLTLLRPEKDGAATRVDAACT
    YRPDPKSPGLDREQLYWELSQLTHSITELGPYTLDRVSLYVNGFNPRSSVPTTSTPGTSTVHLATSGTPSSLPGHT

APVPLLIPFTLNFTITNLHYEENMQHPGSRKFNTTERVLQGLLRPLFKSTSVGPLYSGCRLTLLRPEKHGAATGVDAICT
    LRLDPTGPGLDRERLYWELSQLTNSVTELGPYTLDRDSLYVNGFTQRSSVPTTSIPGTSAVHLETSGTPASLPGHT

APGPLLVPFTLNFTITNLQYEVDMRHPGSRKFNTTERVLQGLLKPLFKSTSVGPLYSGCRLTLLRPEKRGAATGVDTICT
    HRLDPLNPGLDREQLYWELSKLTRGIIELGPYLLDRGSLYVNGFTHRNFVPITSTPGTSTVHLGTSETPSSLPRPI

20  VPGPLLVPFTLNFTITNLQYEEAMRHPGSRKFNTTERVLQGLLRPLFKNTSIGPLYSSCRLTLLRPEKDKAATRVDAICT
    HHPDPQSPGLNREQLYWELSQLTHGITELGPYTLDRDSLYVDGFTHWSPIPTTSTPGTSIVNLGTSGIPPSLPETT

XXXPLLXPFTLNFTITNLXYEEXMXXPGSRKFNTTERVLQGLLKPLFRNSSLEYLYSGCRLASLRPEKDSSAMAVDAICT
    HRPDPEDLGLDRERLYWELSNLTNGIQELGPYTLDRNSLYVNGFTHRSSFLTTSTPWTSTVDLGTSGTPSPVPSPT

TAGPLLVPFTLNFTITNLQYEEDMHRPGSRRFNTTERVLQGLLTPLFKNTSVGPLYSGCRLTLLRPEKQEAATGVDTICT
    HRVDPIGPGLDRERLYWELSQLTNSITELGPYTLDRDSLYVNGFNPWSSVPTTSTPGTSTVHLATSGTPSSLPGHT

APVPLLIPFTLNFTITDLHYEENMQHPGSRKFNTTERVLQGLLKPLFKSTSVGPLYSGCRLTLLRPEKHGAATGVDAICT
    LRLDPTGPGLDRERLYWELSQLTNSVTELGPYTLDRDSLYVNGFTHRSSVPTTSIPGTSAVHLETSGTPASLPGHT

APGPLLVPFTLNFTITNLQYEEDMRHPGSRKFSTTERVLQGLLKPLFKNTSVSSLYSGCRLTLLRPEKDGAATRVDAVCT
    HRPDPKSPGLDRERLYWKLSQLTHGITELGPYTLDRHSLYVNGFTHQSSMTTTRTPDTSTMHLATSRTPASLSGPT

25  TASPLLVLFTINFTITNQRYEENMHHPGSRKFNTTERVLQGLLRPVFKNTSVGPLYSGCRLTLLRPKKDGAATKVDAICT
    YRPDPKSPGLDREQLYWELSQLTHSITELGPYTQDRDSLYVNGFTHRSSVPTTSIPGTSAVHLETSGTPASLPGHT

APGPLLVPFTLNFTITNLQYEEDMRHPGSRKFNTTERVLQGLLKPLFKSTSVGPLYSGCRLTLLRPEKRGAATGVDTICT
    HRLDPLNPGLDREQLYWELSKLTRGIIELGPYLLDRGSLYVNGFTHRTSVPTTSTPGTSTVDLGTSGTPFSLPSPA

XXXPLLXPFTLNFTITNLXYEEXMXXPGSRKFNTTERVLQTLLGPMFKNTSVGLLYSGCRLTLLRSEKDGAATGVDAICT
    HRLDPKSPGVDREQLYWELSQLTNGIKELGPYTLDRNSLYVNGFTHWIPVPTSSTPGTSTVDLG.SGTPSLPSSPT

TAGPLLVPFTLNFTITNLKYEEDMHCPGSRKFNTTERVLQSLLGPMFKNTSVGPLYSGCRLTLLRSEKDGAATGVDAICT
    HRLDPKSPGVDREQLYWELSQLTNGIKELGPYTLDRNSLYVNGFTHQTSAPNTSTPGTSTVDLGTSGTPSSLPSPT

XXXPLLXPFTLNFTITNLXYEEXMXXPGSRKFNTTERVLQGLLXPXFKXTSVGXLYSGCRLTLLRXEKXXAATXVDXXCX
    XXXDPXXPGLDREXLYWELSXLTXXIXELGPYXLDRXSLYVNGFTHWIPVPTSSTPGTSTVDLG.SGTPSSLPSPT

30  TAGPLLVPFTLNFTITNLKYEEDMHCPGSRKFNTTERVLQSLLGPMFKNTSVGPLYSGCRLTSLRSEKDGAATGVDAICT
    HRVDPKSPGVDREQLYWELSQLTNGIKELGPYTLDRNSLYVNGFTHQTSAPNTSTPGTSTVDLGTSGTPSSLPSPT

SAGPLLVPFTLNFTITNLQYEEDMHHPGSRKFNTTERVLQGLLGPMFKNTSVGLLYSGCRLTLLRPEKNGAATGMDAICT
    HRLDPKSPGLDREXLYWELSXLTXXIXELGPYXLDRXSLYVNGFXXXXXXXXTSTPGTSXVXLXTSGTPXXXPXXT

XXXPLLXPFTLNFTITNLXYEEXMXXPGSRKFNTTERVLQGLLKPLFRNSSLEYLYSGCRLASLRPEKDSSAMAVDAICT
    HRPDPEDLGLDRERLYWELSNLTNGIQELGPYTLDRNSLYVNGFTHRSSMPTTSTPGTSTVDVGTSGTPSSSPSPT

TAGPLLIPFTLNFTITNLQYGEDMGHPGSRKFNTTERVLQGLLGPIFKNTSVGPLYSGCRLTSLRSEKDGAATGVDAICI
    HHLDPKSPGLNRERLYWELSQLTNGIKELGPYTLDRNSLYVNGFTHRTSVPTTSTPGTSTVDLGTSGTPFSLPSPA

TAGPLLVLFTLNFTITNLKYEEDMHRPGSRKFNTTERVLQTLLGPMFKNTSVGLLYSGCRLTLLRSEKDGAATGVDAICT
```

TABLE 16-continued

CA125 Repeat Domains
(SEQ ID NO: 146)

```
                HRLDPKSPGLDREXLYWELSXLTXXIXELGPYXLDRXSLYVNGFXXXXXXXXTSTPGTSXVXLXTSGTPXXXPXXT

35  XXXPLLXPFTLNFTITNLXYEEXMXXPGSRKFNTTERVLQGLLRPVFKNTSVGPLYSGCRLTLLRPKKDGAATKVDAICT
    YRPDPKSPGLDREQLYWELSQLTHSITELGPYTQDRDSLYVNGFTHRSSVPTTSIPGTSAVHLETTGTPSSFPGHT

EPGPLLIPFTFNFTITNLRYEENMQHPGSRKFNTTERVLQGLLTPLFKNTSVGPLYSGCRLTLLRPEKQEAATGVDTICT
    HRVDPIGPGLDRERLYWELSQLTNSITELGPYTLDRDSLYVDGFNPWSSVPTTSTPGTSTVHLATSGTPSPLPGHT

APVPLLIPFTLNFTITDLHYEENMQHPGSRKFNTTERVLQGLLKPLFKSTSVGPLYSGCRLTLLRPEKHGAATGVDAICT
    LRLDPTGPGLDRERLYWELSQLTNSITELGPYTLDRDSLYVNGFNPWSSVPTTSTPGTSTVHLATSGTPSSLPGHT

TAGPLLVPFTLNFTITNLKYEEDMHCPGSRKFNTTERVLQSLHGPMFKNTSVGPLYSGCRLTLLRSEKDGAATGVDAICT
    HRLDPKSPGLDREXLYWELSXLTXXIXELGPYXLDRXSLYVNGFXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXCX
    XXXDPXXPGLDREXLYWELSXLTNSITELGPYTLDRDSLYVNGFTHRSSMPTTSIPGTSAVHLETSGTPASLPGHT

40  APGPLLVPFTLNFTITNLQYEEDMRHPGSRKFNTTERVLQGLLKPLFKSTSVGPLYSGCRLTLLRPEKRGAATGVDTICT
    HRLDPLNPGLDREXLYWELSXLTXXIXELGPYXLDRXSLYVNGFXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXCX
    XXXDPXXPGLDREXLYWELSXLTXXIXELGPYXLDRXSLYVNGFHPRSSVPTTSTPGTSTVHLATSGTPSSLPGHT

APVPLLIPFTLNFTITNLHYEENMQHPGSRKFNTTERVLQGLLGPMFKNTSVGLLYSGCRLTLLRPEKNGAATGMDAICS
    HRLDPKSPGLDREXLYWELSXLTXXIXELGPYXLDRXSLYVNGFXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXCX
    XXXDPXXPGLDREXLYWELSXLTXXIXELGPYXLDRXSLYVNGFTHQNSVPTTSTPGTSTVYWATTGTPSSFPGHT

EPGPLLIPFTFNFTITNLHYEENMQHPGSRKFNTTERVLQGLLTPLFKNTSVGPLYSGCRLTLLRPEKQEAATGVDTICT
    HRVDPIGPGLDREXLYWELSXLTXXIXELGPYXLDRXSLYVNGFXXXXXXXXTSTPGTSXVXLXTSGTPXXXPXXT

45  XXXPLLXPFTLNFTITNLXYEEXMXXPGSRKFNTTERVLQGLLXPXFKXTSVGXLYSGCRLTLLRXEKXXAATXVDXXCX
    XXXDPXXPGLDREXLYWELSXLTXXIXELGPYXLDRXSLYVNGFTHRSSVPTTSSPGTSTVHLATSGTPSSLPGHT

APVPLLIPFTLNFTITNLHYEENMQHPGSRKFNTTERVLQGLLKPLFKSTSVGPLYSGCRLTLLRPEKHGAATGVDAICT
    LRLDPTGPGLDREXLYWELSXLTXXIXELGPYXLDRXSLYVNGFXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXCX
    XXXDPXXPGLDREXLYWELSXLTXXIXELGPYXLDRXSLYVNGFTHRTSVPTTSTPGTSTVHLATSGTPSSLPGHT

APVPLLIPFTLNFTITNLQYEEDMHRPGSRKFNTTERVLQGLLSPIFKNSSVGPLYSGCRLTSLRPEKDGAATGMDAVCL
    YHPNPKRPGLDREXLYWELSXLTXXIXELGPYXLDRXSLYVNGFXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXCX
    XXXDPXXPGLDREXLYWELSXLTXXIXELGPYXLDRXSLYVNGFTHWSSGLTTSTPWTSTVDLGTSGTPSPVPSPT

50  TAGPLLVPFTLNFTITNLQYEEDMHRPGSRKFNATERVLQGLLSPIFKNTSVGPLYSGCRLTLLRPEKQEAATGVDTICT
    HRVDPIGPGLDREXLYWELSXLTXXIXELGPYXLDRXSLYVNGFXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXCX
    XXXDPXXPGLDREXLYWELSXLTXXIXELGPYXLDRXSLYVNGFTHRSFGLTTSTPWTSTVDLGTSGTPSPVPSPT

TAGPLLVPFTLNFTITNLQYEEDMHRPGSRKFNTTERVLQGLLTPLFRNTSVSSLYSGCRLTLLRPEKDGAATRVDAVCT
    HRPDPKSPGLDREXLYWELSXLTXXIXELGPYXLDRXSLYVNGFXXXXXXXXTSTPGTSXVXLXTSGTPXXXPXXT

XXXPLLXPFTLNFTITNLXYEEXMXXPGSRKFNTTERVLQGLLXPXFKXTSVGXLYSGCRLTLLRXEKXXAATXVDXXCX
    XXXDPXXPGLDREXLYWELSXLTXXIXELGPYXLDRXSLYVNGFTHWIPVPTSSTPGTSTVDLG.SGTPSSLPSPT

TAGPLLVPFTLNFTITNLQYGEDMGHPGSRKFNTTERVLQGLLGPIFKNTSVGPLYSGCRLTSLRSEKDGAATGVDAICI
    HHLDPKSPGLDREXLYWELSXLTXXIXELGPYXLDRXSLYVNGFXXXXXXXXTSTPGTSXVXLXTSGTPXXXPXXT

55  XXXPLLXPFTLNFTITNLXYEEXMXXPGSRKFNTTERVLQGLLXPXFKXTSVGXLYSGCRLTLLRXEKXXAATXVDXXCX
    XXXDPXXPGLDREXLYWELSXLTXXIXELGPYXLDRXSLYVNGFTHQTFAPNTSTPGTSTVDLGTSGTPSSLPSPT

SAGPLLVPFTLNFTITNLQYEEDMHHPGSRKFNTTERVLQGLLGPMFKNTSVGLLYSGCRLTLLRPEKNGAATRVDAVCT
    HRPDPKSPGLDREXLYWELSXLTXXIXELGPYXLDRXSLYVNGFXXXXXXXXTSTPGTSXVXLXTSGTPXXXPXXT

XXXPLLXPFTLNFTITNLXYEEXMXXPGSRKFNTTERVLQGLLKPLFKSTSVGPLYSGCRLTLLRPEKDGVATRVDAICT
    HRPDPKIPGLDRQQLYWELSQLTHSITELGPYTLDRDSLYVNGFTQRSSVPTTSTPGTFTVQPETSETPSSLPGPT

ATGPVLLPFTLNFTITNLQYEEDMHRPGSRKFNTTERVLQGLLMPLFKNTSVSSLYSGCRLTLLRPEKDGAATRVDAVCT
    HRPDPKSPGLDRERLYWKLSQLTHGITELGPYTLDRHSLYVNGFTHQSSMTTRTPDTSTMHLATSRTPASLSGPT

TASPLLVLFTINFTITNLRYEENMHHPGSRKFNTTERVLQGLLRPVFKNTSVGPLYSGCRLTLLRPKKDGAATKVDAICT
    YRPDPKSPGLDREQLYWELSQLTHSITELGPYTQDRDSLYNVGFTQRSSVPTTSVPGTPTVDLGTSGTPVSKPGPS
```

TABLE 16-continued

CA125 Repeat Domains
(SEQ ID NO: 146)

```
 60 AASPLLVLFTLNGTITNLRYEENMQHPGSRKFNTTERVLQGLLRSLFKSTSVGPLYSGCRLTLLRPEKDGTATGVDAICT
    HHPDPKSPRLDREQLYWELSQLTHNITELGHYALDNDSLFVNGFTHRSSVSTTSTPGTPTVYLGASKTPASIFGPS

AASHLLILFTLNFTITNLRYEENMW.PGSRKFNTTERVLQGLLRPLFKNTSVGPLYSGSRLTLLRPEKDGEATGVDAICT
    HRPDPTGPGLDREQLYLELSQLTHSITELGPYTLDRDSLYVNGFTHRSSVPTTS.....................

TGVVSEEPFTLNFTINNLRYMADMGQPGSLKFNITDNVMKHLLSPLFQRSSLGARYTGCRVIALRSVKNGAETRVDLLCT
    YLQPLSGPGLPIKQVFHELSQQTHGITRLGPYSLDKDSLYLNGYNEPGLDEPPTTPKPATTFLPPLSEATT.....

AMGYHLKTLTLNFTISNLQYSPDMGKGSATFNSTEGVLQHLLRPLFQKSSM.GPFYLGCQLISLRPEKDGAATGVDTTCT
    YHPDPVGPGLDIQQLYWELSQLTHGVTQLGFYVLDRDSLFINGYAPQNLSIRGEYQINFHIVNWNLSNPDPTSSEY
```

TABLE 17

Carboxy Terminal Nucleotide Sequence
(SEQ ID NO: 147)

```
   1  GCCATGGGGT ACCACCTGAA GACCCTCACA CTCAACTTCA CCATCTCCAA
  51  TCTCCAGTAT TCACCAGATA TGGGCAAGGG CTCAGCTACA TTCAACTCCA
 101  CCGAGGGGGT CCTTCAGCAC CTGCTCAGAC CCTTGTTCCA GAAGAGCAGC
 151  ATGGGCCCCT TCTACTTGGG TTGCCAACTG ATCTCCCTCA GGCCTGAGAA
 201  GGATGGGCA GCCACTGGTG TGGACACCAC CTGCACCTAC CACCCTGACC
 251  CTGTGGGCCC CGGGCTGGAC ATACAGCAGC TTTACTGGGA GCTGAGTCAG
 301  CTGACCCATG GTGTCACCCA ACTGGGCTTC TATGTCCTGG ACAGGGATAG
 351  CCTCTTCATC AATGGCTATG CACCCCAGAA TTTATCAATC CGGGGCGAGT
 401  ACCAGATAAA TTTCCACATT GTCAACTGGA ACCTCAGTAA TCCAGACCCC
 451  ACATCCTCAG AGTACATCAC CCTGCTGAGG GACATCCAGG ACAAGGTCAC
 501  CACACTCTAC AAAGGCAGTC AACTACATGA CACATTCCGC TTCTGCCTGG
 551  TCACCAACTT GACGATGGAC TCCGTGTTGG TCACTGTCAA GGCATTGTTC
 601  TCCTCCAATT TGGACCCCAG CCTGGTGGAG CAAGTCTTTC TAGATAAGAC
 651  CCTGAATGCC TCATTCCATT GGCTGGGCTC CACCTACCAG TTGGTGGACA
 701  TCCATGTGAC AGAAATGGAG TCATCAGTTT ATCAACCAAC AAGCAGCTCC
 751  AGCACCCAGC ACTTCTACCT GAATTTCACC ATCACCAACC TACCATATTC
 801  CCAGGACAAA GCCCAGCCAG GCACCACCAA TTACCAGAGG AACAAAAGGA
 851  ATATTGAGGA TGCGCTCAAC CAACTCTTCC GAAACAGCAG CATCAAGAGT
 901  TATTTTTCTG ACTGTCAAGT TTCAACATTC AGGTCTGTCC CAACAGGCA
 951  CCACACCGGG GTGGACTCCC TGTGTAACTT CTCGCCACTG GCTCGGAGAG
                                                           *
1001  TAGACAGAGT TGCCATCTAT GAGGAATTTC TGCGGATGAC CCGGAATGGT
1051  ACCCAGCTGC AGAACTTCAC CCTGGACAGG AGCAGTGTCC TTGTGGATGG
1101  GTATTCTCCC AACAGAAATG AGCCCTTAAC TGGGAATTCT GACCTTCCCT
1151  TCTGGGCTGT CATCCTCATC GGCTTGGCAG GACTCCTGGG ACTCATCACA
1201  TGCCTGATCT GCGGTGTCCT GGTGACCACC CGCCGGCGGA AGAAGGAAGG
1251  AGAATACAAC GTCCAGCAAC AGTGCCCAGG CTACTACCAG TCACACCTAG
1301  ACCTGGAGGA TCTGCAATGA CTGGAACTTG CCGGTGCCTG GGGTGCCTTT
```

TABLE 17-continued

Carboxy Terminal Nucleotide Sequence (SEQ ID NO: 147)

```
1351  CCCCCAGCCA GGGTCCAAAG AAGCTTGGCT GGGGCAGAAA TAAACCATAT

1401  TGGTCGGAAA AAAAAAAAA AA
```

TABLE 18

Carboxy Terminal Amino Acid Sequence (SEQ ID NO: 148)

```
  1   AMGYHLKTLT LNFTISNLQY SPDMGKGSAT FNSTEGVLQH LLRPLFQKSS

51   MGPFYLGCQL ISLRPEKDGA ATGVDTTCTY HPDPVGPGLD IQQLYWELSQ

101   LTHGVTQLGF YVLDRDSLFI NGYAPQNLSI RGEYQINFHI VNWNLSNPDP
               *
151   TSSEYITLLR DIQDKVTTLY KGSQLHDTFR FCLVTNLTMD SVLVTVKALF

201   SSNLDPSLVE QVFLDKTLNA SFHWLGSTYQ LVDIHVTEME SSVYQPTSSS

251   STQHFYLNFT ITNLPYSQDK AQPGTTNYQR NKRNIEDALN QLFRNSSIKS

301   YFSDCQVSTF RSVPNRHHTG VDSLCNFSPL ARRVDRVAIY EEFLRMTRNG

351   TQLQNFTLDR SSVLVDGYSP NRNEPLTGNS DLPFWAVILI GLAGLLGLIT

401   CLICGVLVTT RRRKKEGEYN VQQQCPGYYQ SHLDLEDLQ
```

TABLE 19A

Serine/Threonine o-glycosylation Pattern Predicted for the Amino Terminal End of the CA125 Molecule (SEQ ID NO: 149)

```
SEQ ID NO: 149        Length:   1799
RTDGIMEHITKIPNEAAHRGTIRPVKGPQTSTSPASPKGLHTGGTKRMETTTTALKTTTTALKTTSRATLTTSVYTPTLG    80

TLTPLNASRQMASTILTEMMITTPYVFPDVPETTSSLATSLGAETSTALPRTTPSVLNRESETTASLVSRSGAERSPVIQ   160

TLDVSSSEPDTTASWVIHPAETIPTVSKTTPNFFHSELDTVSSTATSHGADVSSAIPTNISPSELDALTPLVTISGTDTS   240

TTFPTLTKSPHETETRTTWLTHPAETSSTIPRTIPNFSHHESDATPSIATSPGAETSSAIPIMTVSPGAEDLVTSQVTSS   320

GTDRNMTIPTLTLSPGEPKTIASLVTHPEAQTSSAIPTSTISPAVSRLVTSMVTSLAAKTSTTNRALTNSPGEPATTVSL   400

VTHPAQTSPTVPWTTSIFFHSKSDTTPSMTTSHGAESSSAVPTPTVSTEVPGVVTPLVTSSRAVISTTIPILTLSPGEPE   480

TTPSMATSHGEEASSAIPTPTVSPGVPGVVTSLVTSSRAVTSTTIPILTFSLGEPETTPSMATSHGTEAGSAVPTVLPEV   560

PGMVTSLVASSRAVTSTTLPTLTLSPGEPETTPSMATSHGAEASSTVPTVSPEVPGVVTSLVTSSSGVNSTSIPTLILSP   640

GELETTPSMATSHGAEASSAVPTPTVSPGVSGVVTPLVTSSRAVTSTTIPILTLSSSEPETTPSMATSHGVEASSAVLTV   720

SPEVPGMVTSLVTSSRAVTSTTIPTLTISSDEPETTTSLVTHSEAKMISAIPTLAVSPTVQGLVTSLVTSSGSETSAFSN   800

LTVASSQPETIDSWVAHPGTEASSVVPTLTVSTGEPFTNISLVTHPAESSSTLPRTTSRFSHSELDTMPSTVTSPEAESS   880

SAISTTISPGIPGVLTSLVTSSGRDISATFPTVPESPHESEATASWVTHPAVTSTTVPRTTPNYSHSEPDTTPSIATSPG   960

AEATSDFPTITVSPDVPDMVTSQVTSSGTDTSITIPTLTLSSGEPETTTSFITYSETHTSSAIPTLPVSPGASKMLTSLV  1040

ISSGTDSTTTFPTLTETPYEPETTAIQLIHPAETNTMVPRTTPKFSHSKSDTTLPVAITSPGPEASSAVSTTTISPDMSD  1120

LVTSLVPSSGTDTSTTFPTLSETPYEPETTATWLTHPAETSTTVSGTIPNFSHRGSDTAPSMVTSPGVDTRSGVPTTTIP  1200

PSIPGVVTSQVTSSATDTSTAIPTLTPSPGEPETTASSATHPGTQTGFTVPIRTVPSSEPDTMASWVTHPPQTSTPVSRT  1280

TSSFSHSSPDATPVMATSPRTEASSAVLTTISPGAPEMVTSQITSSGAATSTTVPTLTHSPGMPETTALLSTHPRTETSK  1360

TFPASTVFPQVSETTASLTIRPGAETSTALPTQTTSSLFTLLVTGTSRVDLSPTASPGVSAKTAPLSTHPGTETSTMIPT  1440

STLSLGLLETTGLLATSSSAETSTSTLTLTVSPAVSGLSSASITTDKPQTVTSWNTETSPSVTSVGPPEFSRTVTGTTMT  1520
```

TABLE 19A-continued

Serine/Threonine o-glycosylation Pattern Predicted for the
Amino Terminal End of the CA125 Molecule
(SEQ ID NO: 149)

```
LIPSEMPTPPKTSHGEGVSPTTILRTTMVEATNLATTGSSPTVAKTTTTFNTLAGSLFTPLTTPGMSTLASESVTSRTSY    1600

NHRSWISTTSSYNRRYWTPATSTPVTSTFSPGISTSSIPSSTAATVPFMVPFTLNFTITNLQYEEDMRHPGSRKFNATER    1680

ELQGLLKPLFRNSSLEYLYSGCRLASLRPEKDSSAMAVDAICTHRPDPEDLGLDRERLYWELSNLTNGIQELGPYTLDRN    1760

SLYVNGFTHRSSMPTTSTPGTSTVDVGTSGTPSSSPSPT
```

TABLE 19B

```
.....................T.......TSTS.................TTT....TTTT...TT.....TT...T....   80
........................................ST....TT..........................        160
.....S.....T...........T.S................T........S.........S............S.T..S   240
T...T.T.................TSS....T.........S..T.S..TS......S.....T..........T...TS.  320
...........T.S.....T..S........TSS...TST..............T......STT....T.S.....TT.S.  400
.T.....TS.T...T........S..T...TTS....SSS...T.T.ST..................T.....T.S.....  480
TT.S..T......SS...T.T.S............S......T..........T.S..TS......S...T.....      560
................T.....T.S.....TT.S..TS.....SST..T.S............TS.S.....T........  640
.....T.S..T.......SS...T.T.S...S..........S.....T......T.SSS....T.S..TS......S..... 720
S.............S.....STT..T.T.SS.....TT...........S....................T..........  800
....S.................SS.....T............T....SSS....T.............ST.T......S   880
S...TT.S...................S....T......S..T....T....TSTT...TT...S.S.....T.S..TS..  960
...TS.....T.........T...TS..........T.T.SS.....T....T.....T.S...T................  1040
.S..T.STTT..T.T.T.................T....TT.......S........S......SS....TT.......   1120
.......S..T..STT..T.S.T.....TT....T......ST.....................TS......S....TT..  1200
.S.....T...TS..T.TST...T.T.S.....TT.SS.T..........T..SS...T..S..T....TST..S.T      1280
TSS.S.SS...T....TS..T...SS....T.S........T...TS....TSTT....T.S..........ST...T..S. 1360
....ST.....S.TT...T.......ST...T.TT.S.............T.S...S......ST...T..ST...T     1440
ST..............T..S..TSTS....T.....S..S..S...T....T.TS..T...S.S.TS......S.........T  1520
...S...T....S........T............TT.SS.T.....................T...ST..S..........  1600
...................TST..TST.S...STSS..SST........................                 1680
                                                                                    1760
............TTST...ST.....TS.T.SSS.S.T
```

TABLE 20

Nucleotide and Amino Acid Sequences of
Recombinant CA125 Repeat Showing Peptides
(Underlined 1-4) which are Antigenically Matched for Immune
Stimulation of Patients with the HLA-2 Histocompatibility Subtype
CA 125 Recombinant Nucleotide and Amino Acid Sequences
(SEQ ID NO: 151 and SEQ ID NO: 152, respectively)
CA 125 Recombinant Nucleotide (Anti-Sense Strand) Sequence
(SEQ ID NO: 153)
Peptide 1 (SEQ ID NO: 154); Peptide 2 (SEQ ID NO: 155);
Peptide 3 (SEQ ID NO: 156) and Peptide 4 (SEQ ID NO: 157)

```
       ATGAGAGGATCGCATCACCATCACCATCACGGATCCATGGGCCACACAGAGCCTGGCCCT
  1    ---------+---------+---------+---------+---------+---------+  60
       TACTCTCCTAGCGTAGTGGTAGTGGTAGTGCCTAGGTACCCGGTGTGTCTCGGACCGGGA

M   R   G   S   H   H   H   H   H   H   G   S   M   G   H   T   E   P   G   P   -

↑
       CTCCTGATACCATTCACTTTCAACTTTACCATCACCAACCTGCATTATGAGGAAAACATG
 61    ---------+---------+---------+---------+---------+---------+ 120
       GAGGACTATGGTAAGTGAAAGTTGAAATGGTAGTGGTTGGACGTAATACTCCTTTTGTAC

L   L   I   P   F   T   F   N   F   T   I   T   N   L   H   Y   E   E   N   M   -

CAACACCCTGGTTCCAGGAAGTTCAACACCACGGAGAGGGTTCTGCAGGGTCTGCTCAAG
121    ---------+---------+---------+---------+---------+---------+ 180
       GTTGTGGGACCAAGGTCCTTCAAGTTGTGGTGCCTCTCCCAAGACGTCCCAGACGAGTTC
                                                    3
        Q   H   P   G   S   R   K   F   N   T   T   E   R   V   L   Q   G   L   L   K   -

CCCTTGTTCAAGAACACCAGTGTTGGCCCTCTGTACTCTGGCTGCAGACTGACCTTGCTC
181    ---------+---------+---------+---------+---------+---------+ 240
       GGGAACAAGTTCTTGTGGTCACAACCGGGAGACATGAGACCGACGTCTGACTGGAACGAG

P   L   F   K   N   T   S   V   G   P   L   Y   S   G   C   R   L   T   L   L   -

AGACCTGAGAAGCATGAGGCAGCCACTGGAGTGGACACCATCTGTACCCACCGCGTTGAT
241    ---------+---------+---------+---------+---------+---------+ 300
       TCTGGACTCTTCGTACTCCGTCGGTGACCTCACCTGTGGTAGACATGGGTGGCGCAACTA

R   P   E   K   H   E   A   A   T   G   V   D   T   I   C   T   H   R   V   D   -

CCCATCGGACCTGGACTGGACAGAGAGCGGCTATACTGGGAGCTGAGCCAGCTGACCAAC
301    ---------+---------+---------+---------+---------+---------+ 360
       GGGTAGCCTGGACCTGACCTGTCTCTCGCCGATATGACCCTCGACTCGGTCGACTGGTTG
                                       1                   4
        P   I   G   P   G   L   D   R   E   R   L   Y   W   E   L   S   Q   L   T   N   -

AGCATCACAGAGCTGGGACCCTACACCCTGGACAGGGACAGTCTCTATGTCAATGGCTTC
361    ---------+---------+---------+---------+---------+---------+ 420
       TCGTAGTGTCTCGACCCTGGGATGTGGGACCTGTCCCTGTCAGAGATACAGTTACCGAAG
                                  2
        S   I   T   E   L   G   P   Y   T   L   D   R   D   S   L   Y   V   N   G   F   -

AACCCTCGGAGCTCTGTGCCAACCACCAGCACTCCTGGGACCTCCACAGTGCACCTGGCA
421    ---------+---------+---------+---------+---------+---------+ 480
       TTGGGAGCCTCGAGACACGGTTGGTGGTCGTGAGGACCCTGGAGGTGTCACGTGGACCGT

N   P   R   S   S   V   P   T   T   S   T   P   G   T   S   T   V   H   L   A   -

ACCTCTGGGACTCCATCCTCCCTGCCT
481    ---------+---------+------- 507
       TGGAGACCCTGAGGTAGGAGGGACGGA

T   S   G   T   P   S   S   L   P   -
```

Peptide 1          R L Y W E L S Q L          (SEQ ID NO: 154)

Peptide 2          T L D R D S L Y V          (SEQ ID NO: 155)

Peptide 3          V L Q G L L K P L          (SEQ ID NO: 156)

Peptide 4          Q L T N S I T E L          (SEQ ID NO: 157)

TABLE 21

CA125 Protein Sequence
(SEQ ID NO: 162)

Amino Terminal Domain

```
   1  MEHITKIPNE AAHRGTIRPV KGPQTSTSPA SPKGLHTGGT KRMETTTTAL
  51  KTTTTALKTT SRATLTTSVY TPTLGTLTPL NASRQMASTI LTEMMITTPY
 101  VFPDVPETTS SLATSLGAET STALPRTTPS VLNRESETTA SLVSRSGAER
 151  SPVIQTLDVS SSEPDTTASW VIHPAETIPT VSKTTPNFFH SELDTVSSTA
 201  TSHGADVSSA IPTNISPSEL DALTPLVTIS GTDTSTTFPT LTKSPHETET
 251  RTTWLTHPAE TSSTIPRTIP NFSHHESDAT PSIATSPGAE TSSAIPIMTV
 301  SPGAEDLVTS QVTSSGTDRN MTIPTLTLSP GEPKTIASLV THPEAQTSSA
 351  IPTSTISPAV SRLVTSMVTS LAAKTSTTNR ALTNSPGEPA TTVSLVTHPA
 401  QTSPTVPWTT SIFFHSKSDT TPSMTTSHGA ESSSAVPTPT VSTEVPGVVT
 451  PLVTSSRAVI STTIPILTLS PGEPETTPSM ATSHGEEASS AIPTPTVSPG
 501  VPGVVTSLVT SSRAVTSTTI PILTFSLGEP ETTPSMATSH GTEAGSAVPT
 551  VLPEVPGMVT SLVASSRAVT STTLPTLTLS PGEPETTPSM ATSHGAEASS
 601  TVPTVSPEVP GVVTSLVTSS SGVNSTSIPT LILSPGELET TPSMATSHGA
 651  EASSAVPTPT VSPGVSGVVT PLVTSSRAVT STTIPILTLS SSEPETTPSM
 701  ATSHGVEASS AVLTVSPEVP GMVTSLVTSS RAVTSTTIPT LTISSDEPET
 751  TTSLVTHSEA KMISAIPTLA VSPTVQGLVT SLVTSSGSET SAFSNLTVAS
 801  SQPETIDSWV AHPGTEASSV VPTLTVSTGE PFTNISLVTH PAESSSTLPR
 851  TTSRFSHSEL DTMPSTVTSP EAESSSAIST TISPGIPGVL TSLVTSSGRD
 901  ISATFPTVPE SPHESEATAS WVTHPAVTST TVPRTTPNYS HSEPDTTPSI
 951  ATSPGAEATS DFPTITVSPD VPDMVTSQVT SSGTDTSITI PTLTLSSGEP
1001  ETTTSFITYS ETHTSSAIPT LPVSPGASKM LTSLVISSGT DSTTTFPTLT
1051  ETPYEPETTA IQLIHPAETN TMVPRTTPKF SHSKSDTTLP VAITSPGPEA
1101  SSAVSTTTIS PDMSDLVTSL VPSSGTDTST TFPTLSETPY EPETTATWLT
1151  HPAETSTTVS GTIPNFSHRG SDTAPSMVTS PGVDTRSGVP TTTIPPSIPG
1201  VVTSQVTSSA TDTSTAIPTL TPSPGEPETT ASSATHPGTQ TGFTVPIRTV
1251  PSSEPDTMAS WVTHPPQTST PVSRTTSSFS HSSPDATPVM ATSPRTEASS
1301  AVLTTISPGA PEMVTSQITS SGAATSTTVP TLTHSPGMPE TTALLSTHPR
1351  TETSKTFPAS TVFPQVSETT ASLTIRPGAE TSTALPTQTT SSLFTLLVTG
1401  TSRVDLSPTA SPGVSAKTAP LSTHPGTETS TMIPTSTLSL GLLETTGLLA
1451  TSSSAETSTS TLTLTVSPAV SGLSSASITT DKPQTVTSWN TETSPSVTSV
1501  GPPEFSRTVT GTTMTLIPSE MPTPPKTSHG EGVSPTTILR TTMVEATNLA
1551  TTGSSPTVAK TTTTFNTLAG SLFTPLTTPG MSTLASESVT SRTSYNHRSW
1601  ISTTSSYNRR YWTPATSTPV TSTFSPGIST SSIPSSTA
```

Repeat Domain

```
                                                  AT VPFMVPFTLN
1651  FTITNLQYEE DMRHPGSRKF NATERELQGL LKPLFRNSSL EYLYSGCRLA
1701  SLRPEKDSSA MAVDAICTHR PDPEDLGLDR ERLYWELSNL TNGIQELGPY
1751  TLDRNSLYVN GFTHRSSMPT TSTPGTSTVD VGTSGTPSSS PSPTAAGPLL
1801  MPFTLNFTIT NLQYEEDMRR TGSRKFNTME SVLQGLLKPL FKNTSVGPLY
```

TABLE 21-continued

CA125 Protein Sequence
(SEQ ID NO: 162)

```
1851  SGCRLTLLRP EKDGAATGVD AICTHRLDPK SPGLNREQLY WELSKLTNDI

1901  EELGPYTLDR NSLYVNGFTH QSSVSTTSTP GTSTVDLRTS GTPSSLSSPT

1951  IMAAGPLLVP FTLNFTITNL QYGEDMGHPG SRKFNTTERV LQGLLGPIFK

2001  NTSVGPLYSG CRLTSLRSEK DGAATGVDAI CIHHLDPKSP GLNRERLYWE

2051  LSQLTNGIKE LGPYTLDRNS LYVNGFTHRT SVPTSSTPGT STVDLGTSGT

2101  PFSLPSPATA GPLLVLFTLN FTITNLKYEE DMHRPGSRKF NTTERVLQTL

2151  LGPMFKNTSV GLLYSGCRLT LLRSEKDGAA TGVDAICTHR LDPKSPGLDR

2201  EQLYWELSQL TNGIKELGPY TLDRNSLYVN GFTHWIPVPT SSTPGTSTVD

2251  LGSGTPSSLP SPTAAGPLLV PFTLNFTITN LQYEEDMHHP GSRKFNTTER

2301  VLQGLLGPMF KNTSVGLLYS GCRLTLLRSE KDGAATGVDA ICTHRLDPKS

2351  PGVDREQLYW ELSQLTNGIK ELGPYTLDRN SLYVNGFTHQ TSAPNTSTPG

2401  TSTVDLGTSG TPSSLPSPTS AGPLLVPFTL NFTITNLQYE EDMRHPGSRK

2451  FNTTERVLQG LLKPLFKSTS VGPLYSGCRL TLLRSEKDGA ATGVDAICTH

2501  RLDPKSPGVD REQLYWELSQ LTNGIKELGP YTLDRNSLYV NGFTHQTSAP

2551  NTSTPGTSTV DLGTSGTPSS LPSPTSAGPL LVPFTLNFTI TNLQYEEDMH

2601  HPGSRKFNTT ERVLQGLLGP MFKNTSVGLL YSGCRLTLLR PEKNGAATGM

2651  DAICSHRLDP KSPGLNREQL YWELSQLTHG IKELGPYTLD RNSLYVNGFT

2701  HRSSVAPTST PGTSTVDLGT SGTPSSLPSP TTAVPLLVPF TLNFTITNLQ

2751  YGEDMRHPGS RKFNTTERVL QGLLGPLFKN SSVGPLYSGC RLISLRSEKD

2801  GAATGVDAIC THHLNPQSPG LDREQLYWQL SQMTNGIKEL GPYTLDRNSL

2851  YVNGFTHRSS GLTTSTPWTS TVDLGTSGTP SPVPSPTTAG PLLVPFTLNF

2901  TITNLQYEED MHRPGSRKFN ATERVLQGLL SPIFKNSSVG PLYSGCRLTS

2951  LRPEKDGAAT GMDAVCLYHP NPKRPGLDRE QLYWELSQLT HNITELGPYS

3001  LDRDSLYVNG FTHQNSVPTT STPGTSTVYW ATTGTPSSFP GHTEPGPLLI

3051  PFTFNFTITN LHYEENMQHP GSRKFNTTER VLQGLLKPLF KNTSVGPLYS

3101  GCRLTSLRPE KDGAATGMDA VCLYHPNPKR PGLDREQLYC ELSQLTHNIT

3151  ELGPYSLDRD SLYVNGFTHQ NSVPTTSTPG TSTVYWATTG TPSSFPGHTE

3201  PGPLLIPFTF NFTITNLHYE ENMQHPGSRK FNTTERVLQG LLKPLFKNTS

3251  VGPLYSGCRL TLLRPEKHEA ATGVDTICTH RVDPIGPGLD RERLYWELSQ

3301  LTNSITELGP YTLDRDSLYV NGFNPRSSVP TTSTPGTSTV HLATSGTPSS

3351  LPGHTAPVPL LIPFTLNFTI TNLHYEENMQ HPGSRKFNTT ERVLQGLLKP

3401  LFKNTSVGPL YSGCRLTLLR PEKHEAATGV DTICTHRVDP IGPGLDREXL

3451  YWELSXLTXX IXELGPYXLD RXSLYVNGFX XXXXXXXTST PGTSXVXLXT

3501  SGTPXXXPXX TSAGPLLVPF TLNFTITNLQ YEEDMHHPGS RKFNTTERVL

3551  QGLLGPMFKN TSVGLLYSGC RLTLLRPEKN GAATGMDAIC SHRLDPKSPG

3601  LDREQLYWEL SQLTHGIKEL GPYTLDRNSL YVNGFTHRSS VAPTSTPGTS

3651  TVDLGTSGTP SSLPSPTTAV PLLVPFTLNF TITNLQYGED MRHPGSRKFN

3701  TTERVLQGLL GPLFKNSSVG PLYSGCRLIS LRSEKDGAAT GVDAICTHHL
```

TABLE 21-continued

CA125 Protein Sequence
(SEQ ID NO: 162)

```
3751 NPQSPGLDRE QLYWQLSQMT NGIKELGPYT LDRNSLYVNG FTHRSSGLTT
3801 STPWTSTVDL GTSGTPSPVP SPTTAGPLLV PFTLNFTITN LQYEEDMHRP
3851 GSRKFNATER VLQGLLSPIF KNSSVGPLYS GCRLTSLRPE KDGAATGMDA
3901 VCLYHPNPKR PGLDREQLYW ELSQLTHNIT ELGPYSLDRD SLYVNGFTHQ
3951 SSMTTTRTPD TSTMHLATSR TPASLSGPTT ASPLLVLFTI NCTITNLQYE
4001 EDMRRTGSRK FNTMESVLQG LLKPLFKNTS VGPLYSGCRL TLLRPKKDGA
4051 ATGVDAICTH RLDPKSPGLN REQLYWELSK LTNDIEELGP YTLDRNSLYV
4101 NGFTHQSSVS TTSTPGTSTV DLRTSGTPSS LSSPTIMXXX PLLXPFTLNF
4151 TITNLXYEEX MXXPGSRKFN TTERVLQGLL RPLFKNTSVS SLYSGCRLTL
4201 LRPEKDGAAT RVDAACTYRP DPKSPGLDRE QLYWELSQLT HSITELGPYT
4251 LDRVSLYVNG FNPRSSVPTT STPGTSTVHL ATSGTPSSLP GHTXX XPLL
4301 XPFTLNFTIT NLXYEEXMXX PGSRKFNTTE RVLQGLLKPL FRNSSLEYLY
4351 SGCRLASLRP EKDSSAMAVD AICTHRPDPE DLGLDRERLY WELSNLTNGI
4401 QELGPYTLDR NSLYVNGFTH RSSFLTTSTP WTSTVDLGTS GTPSPVPSPT
4451 TAGPLLVPFT LNFTITNLQY EEDMHRPGSR RFNTTERVLQ GLLTPLFKNT
4501 SVGPLYSGCR LTLLRPEKQE AATGVDTICT HRVDPIGPGL DRERLYWELS
4551 QLTNSITELG PYTLDRDSLY VNGFNPWSSV PTTSTPGTST VHLATSGTPS
4601 SLPGHTAPVP LLIPFTLNFT ITDLHYEENM QHPGSRKFNT TERVLQGLLK
4651 PLFKSTSVGP LYSGCRLTLL RPEKHGAATG VDAICTLRLD PTGPGLDRER
4701 LYWELSQLTN SVTELGPYTL DRDSLYVNGF THRSSVPTTS IPGTSAVHLE
4751 TSGTPASLPG HTAPGPLLVP FTLNFTITNL QYEEDMRHPG SRKFSTTERV
4801 LQGLLKPLFK NTSVSSLYSG CRLTLLRPEK DGAATRVDAV CTHRPDPKSP
4851 GLDRERLYWK LSQLTHGITE LGPYTLDRHS LYVNGFTHQS SMTTTRTPDT
4901 STMHLATSRT PASLSGPTTA SPLLVLFTIN FTITNQRYEE NMHHPGSRKF
4951 NTTERVLQGL LRPVFKNTSV GPLYSGCRLT LLRPKKDGAA TKVDAICTYR
5001 PDPKSPGLDR EQLYWELSQL THSITELGPY TQDRDSLYVN GFTHRSSVPT
5051 TSIPGTSAVH LETSGTPASL PGHTAPGPLL VPFTLNFTIT NLQYEEDMRH
5101 PGSRKFNTTE RVLQGLLKPL FKSTSVGPLY SGCRLTLLRP EKRGAATGVD
5151 TICTHRLDPL NPGLDREQLY WELSKLTRGI IELGPYLLDR GSLYVNGFTH
5201 RTSVPTTSTP GTSTVDLGTS GTPFSLPSPA XXXPLLXPFT LNFTITNLXY
5201 EEXMXXPGSR KFNTTERVLQ TLLGPMFKNT SVGLLYSGCR LTLLRSEKDG
5251 AATGVDAICT HRLDPKSPGV DREQLYWELS QLTNGIKELG PYTLDRNSLY
5301 VNGFTHWIPV PTSSTPGTST VDLGSGTPSL PSSPTTAGPL LVPFTLNFTI
5351 TNLKYEEDMH CPGSRKFNTT ERVLQSLLGP MFKNTSVGPL YSGCRLTLLR
5401 SEKDGAATGV DAICTHRLDP KSPGVDREQL YWELSQLTNG IKELGPYTLD
5451 RNSLYVNGFT HQTSAPNTST PGTSTVDLGT SGTPSSLPSP TXXXPLLXPF
5501 TLNFTITNLX YEEXMXXPGS RKFNTTERVL QGLLXPXFKX TSVGXLYSGC
5551 RLTLLRXEKX XAATXVDXXC XXXXDPXXPG LDREXLYWEL SXLTXXIXEL
5601 GPYXLDRXSL YVNGFTHWIP VPTSSTPGTS TVDLGSGTPS SLPSPTTAGP
```

TABLE 21-continued

CA125 Protein Sequence
(SEQ ID NO: 162)

```
5651 LLVPFTLNFT ITNLKYEEDM HCPGSRKFNT TERVLQSLLG PMFKNTSVGP

5701 LYSGCRLTSL RSEKDGAATG VDAICTHRVD PKSPGVDREQ LYWELSQLTN

5751 GIKELGPYTL DRNSLYVNGF THQTSAPNTS TPGTSTVDLG TSGTPSSLPS

5801 PTSAGPLLVP FTLNFTITNL QYEEDMHHPG SRKFNTTERV LQGLLGPMFK

5851 NTSVGLLYSG CRLTLLRPEK NGAATGMDAI CTHRLDPKSP GLDREXLYWE

5901 LSXLTXXIXE LGPYXLDRXS LYVNGFXXXX XXXXTSTPGT SXVXLXTSGT

5951 PXXXPXXTXX XPLLXPFTLN FTITNLXYEE XMXXPGSRKF NTTERVLQGL

6001 LKPLFRNSSL EYLYSGCRLA SLRPEKDSSA MAVDAICTHR PDPEDLGLDR

6051 ERLYWELSQL TNGIQELGPY TLDRNSLYVN GFTHRSSMPT TSTPGTSTVD

6101 VGTSGTPSSS PSPTTAGPLL IPFTLNFTIT NLQYGEDMGH PGSRKFNTTE

6151 RVLQGLLGPI FKNTSVGPLY SGCRLTSLRS EKDGAATGVD AICIHHLDPK

6201 SPGLNRERLY WELSQLTNGI KELGPYTLDR NSLYVNGFTH RTSVPTTSTP

6251 GTSTVDLGTS GTPFSLPSPA TAGPLLVLFT LNFTITNLKY EEDMHRPGSR

6301 KFNTTERVLQ TLLGPMFKNT SVGLLYSGCR LTLLRSEKDG AATGVDAICT

6351 HRLDPKSPGL DREXLYWELS XLTXXIXELG PYXLDRXSLY VNGFXXXXXX

6401 XXTSTPGTSX VXLXTSGTPX XXPXXTXXXP LLXPFTLNFT ITNLXYEEXM

6451 XXPGSRKFNT TERVLQGLLR PVFKNTSVGP LYSGCRLTLL RPKKDGAATK

6501 VDAICTYRPD PKSPGLDREQ LYWELSQLTH SITELGPYTQ DRDSLYVNGF

6551 THRSSVPTTS IPGTSAVHLE TTGTPSSFPG HTEPGPLLIP FTFNFTITNL

6601 RYEENMQHPG SRKFNTTERV LQGLLTPLFK NTSVGPLYSG CRLTLLRPEK

6651 QEAATGVDTI CTHRVDPIGP GLDRERLYWE LSQLTNSITE LGPYTLDRDS

6701 LYVDGFNPWS SVPTTSTPGT STVHLATSGT PSPLPGHTAP VPLLIPFTLN

6751 FTITDLHYEE NMQHPGSRKF NTTERVLQGL LKPLFKSTSV GPLYSGCRLT

6801 LLRPEKHGAA TGVDAICTLR LDPTGPGLDR ERLYWELSQL TNSITELGPY

6851 TLDRDSLYVN GFNPWSSVPT TSTPGTSTVH LATSGTPSSL PGHTTAGPLL

6901 VPFTLNFTIT NLKYEEDMHC PGSRKFNTTE RVLQSLHGPM FKNTSVGPLY

6951 SGCRLTLLRS EKDGAATGVD AICTHRLDPK SPGLDREXLY WELSXLTXXI

7001 XELGPYXLDR XSLYVNGFXX XXXXXXTSTP GTSXVXLXTS GTPXXXPXXT

7051 XXXPLLXPFT LNFTITNLXY EEXMXXPGSR KFNTTERVLQ GLLXPXFKXT

7101 SVGXLYSGCR LTLLRXEKXX AATXVDXXCX XXXDPXXPGL DREXLYWELS

7151 XLTNSITELG PYTLDRDSLY VNGFTHRSSM PTTSIPGTSA VHLETSGTPA

7201 SLPGHTAPGP LLVPFTLNFT ITNLQYEEDM RHPGSRKFNT TERVLQGLLK

7251 PLFKSTSVGP LYSGCRLTLL RPEKRGAATG VDTICTHRLD PLNPGLDREX

7301 LYWELSXLTX XIXELGPYXL DRXSLYVNGF XXXXXXXXTS TPGTSXVXLX

7351 TSGTPXXXPX XTXXXPLLXP FTLNFTITNL XYEEXMXXPG SRKFNTTERV

7401 LQGLLXPXFK XTSVGXLYSG CRLTLLRXEK XXAATXVDXX CXXXXDPXXP

7451 GLDREXLYWE LSXLTXXIXE LGPYXLDRXS LYVNGFHPRS VPTTSTPGT

7501 STVHLATSGT PSSLPGHTAP VPLLIPFTLN FTITNLHYEE NMQHPGSRKF
```

TABLE 21-continued

CA125 Protein Sequence
(SEQ ID NO: 162)

```
7551  NTTERVLQGL LGPMFKNTSV GLLYSGCRLT LLRPEKNGAA TGMDAICSHR
7601  LDPKSPGLDR EXLYWELSXL TXXIXELGPY XLDRXSLYVN GFXXXXXXXX
7651  TSTPGTSXVX LXTSGTPXXX PXXTXXXPLL XPFTLNFTIT NLXYEEXMXX
7701  PGSRKFNTTE RVLQGLLXPX FKXTSVGXLY SGCRLTLLRX EKXXAATXVD
7751  XXCXXXXDPX XPGLDREXLY WELSXLTXXI XELGPYXLDR XSLYVNGFTH
7801  QNSVPTTSTP GTSTVYWATT GTPSSFPGHT EPGPLLIPFT FNFTITNLHY
7851  EENMQHPGSR KFNTTERVLQ GLLTPLFKNT SVGPLYSGCR LTLLRPEKQE
7901  AATGVDTICT HRVDPIGPGL DREXLYWELS XLTXXIXELG PYXLDRXSLY
7951  VNGFXXXXXX XXTSTPGTSX VXLXTSGTPX XXPXXTXXXP LLXPFTLNFT
8001  ITNLXYEEXM XXPGSRKFNT TERVLQGLLX PXFKXTSVGX LYSGCRLTLL
8051  RXEKXXAATX VDXXCXXXXD PXXPGLDREX LYWELSXLTX XIXELGPYXL
8101  DRXSLYVNGF THRSSVPTTS SPGTSTVHLA TSGTPSSLPG HTAPVPLLIP
8151  FTLNFTITNL HYEENMQHPG SRKFNTTERV LQGLLKPLFK STSVGPLYSG
8201  CRLTLLRPEK HGAATGVDAI CTLRLDPTGP GLDREXLYWE LSXLTXXIXE
8251  LGPYXLDRXS LYVNGFXXXX XXXXTSTPGT SXVXLXTSGT PXXXPXXTXX
8301  XPLLXPFTLN FTITNLXYEE XMXXPGSRKF NTTERVLQGL LXPXFKXTSV
8351  GXLYSGCRLT LLRXEKXXAA TXVDXXCXXX XDPXXPGLDR EXLYWELSXL
8401  TXXIXELGPY XLDRXSLYVN GFTHRTSVPT TSTPGTSTVH LATSGTPSSL
8451  PGHTAPVPLL IPFTLNFTIT NLQYEEDMHR PGSRKFNTTE RVLQGLLSPI
8501  FKNSSVGPLY SGCRLTSLRP EKDGAATGMD AVCLYHPNPK RPGLDREQLY
8551  CELSQLTHNI TELGPYSLDR DSLYVNGFTH QNSVPTTSTP GTSTVYWATT
8601  GTPSSFPGHT XXXPLLXPFT LNFTITNLXY EEXMXXPGSR KFNTTERVLQ
8651  GLLXPXFKXT SVGXLYSGCR LTLLRXEKXX AATXVDXXCX XXXDPXXPGL
8701  DREXLYWELS XLTXXIXELG PYXLDRXSLY VNGFTHWSSG LTTSTPWTST
8751  VDLGTSGTPS PVPSPTTAGP LLVPFTLNFT ITNLQYEEDM HRPGSRKFNA
8801  TERVLQGLLS PIFKNTSVGP LYSGCRLTLL RPEKQEAATG VDTICTHRVD
8851  PIGPGLDREX LYWELSXLTX XIXELGPYXL DRXSLYVNGF XXXXXXXXTS
8901  TPGTSXVXLX TSGTPXXXPX XTXXXPLLXP FTLNFTITNL XYEEXMXXPG
8951  SRKFNTTERV LQGLLXPXFK XTSVGXLYSG CRLTLLRXEK XXAATXVDXX
9001  CXXXXDPXXP GLDREXLYWE LSXLTXXIXE LGPYXLDRXS LYVNGFTHRS
9051  FGLTTSTPWT STVDLGTSGT PSPVPSPTTA GPLLVPFTLN FTITNLQYEE
9101  DMHRPGSRKF NTTERVLQGL LTPLFRNTSV SSLYSGCRLT LLRPEKDGAA
9151  TRVDAVCTHR PDPKSPGLDR EXLYWELSXL TXXIXELGPY XLDRXSLYVN
9201  GFXXXXXXXX TSTPGTSXVX LXTSGTPXXX PXXTXXXPLL XPFTLNFTIT
9251  NLXYEEXMXX PGSRKFNTTE RVLQGLLXPX FKXTSVGXLY SGCRLTLLRX
9301  EKXXAATXVD XXCXXXXDPX XPGLDREXLY WELSXLTXXI XELGPYXLDR
9351  XSLYVNGFTH WIPVPTSSTP GTSTVDLGSG TPSSLPSPTT AGPLLVPFTL
9401  NFTITNLQYG EDMGHPGSRK FNTTERVLQG LLGPIFKNTS VGPLYSGCRL
9451  TSLRSEKDGA ATGVDAICIH HLDPKSPGLD REXLYWELSX LTXXIXELGP
```

TABLE 21-continued

CA125 Protein Sequence
(SEQ ID NO: 162)

```
 9501  YXLDRXSLYV NGFXXXXXXX XTSTPGTSXV XLXTSGTPXX XPXXTXXXPL
 9551  LXPFTLNFTI TNLXYEEXMX XPGSRKFNTT ERVLQGLLXP XFKXTSVGXL
 9601  YSGCRLTLLR XEKXXAATXV DXXCXXXXDP XXPGLDREXL YWELSXLTXX
 9651  IXELGPYXLD RXSLYVNGFT HQTFAPNTST PGTSTVDLGT SGTPSSLPSP
 9701  TSAGPLLVPF TLNFTITNLQ YEEDMHHPGS RKFNTTERVL QGLLGPMFKN
 9751  TSVGLLYSGC RLTLLRPEKN GAATRVDAVC THRPDPKSPG LDREXLYWEL
 9801  SXLTXXIXEL GPYXLDRXSL YVNGFXXXXX XXXTSTPGTS XVXLXTSGTP
 9851  XXXPXXTAPV PLLIPFTLNF TITNLHYEEN MQHPGSRKFN TTERVLQGLL
 9901  RPLFKSTSVG PLYSGCRLTL LRPEKHGAAT GVDAICTLRL DPTGPGLDRE
 9951  RLYWELSQLT NSVTELGPYT LDRDSLYVNG FTQRSSVPTT SIPGTSAVHL
10001  ETSGTPASLP GHTAPGPLLV PFTLNFTITN LQYEVDMRHP GSRKFNTTER
10051  VLQGLLKPLF KSTSVGPLYS GCRLTLLRPE KRGAATGVDT ICTHRLDPLN
10101  PGLDREQLYW ELSKLTRGII ELGPYLLDRG SLYVNGFTHR NFVPITSTPG
10151  TSTVHLGTSE TPSSLPRPIV PGPLLVPFTL NFTITNLQYE EAMRHPGSRK
10201  FNTTERVLQG LLRPLFKNTS IGPLYSSCRL TLLRPEKDKA ATRVDAICTH
10251  HPDPQSPGLN REQLYWELSQ LTHGITELGP YTLDRDSLYV DGFTHWSPIP
10301  TTSTPGTSIV NLGTSGIPPS LPETTXXXPL LXPFTLNFTI TNLXYEEXMX
10351  XPGSRKFNTT ERVLQGLLKP LFKSTSVGPL YSGCRLTLLR PEKDGVATRV
10451  DAICTHRPDP KIPGLDRQQL YWELSQLTHS ITELGPYTLD RDSLYVNGFT
10501  QRSSVPTTST PGTFTVQPET SETPSSLPGP TATGPVLLPF TLNFTITNLQ
10551  YEEDMHRPGS RKFNTTERVL QGLLMPLFKN TSVSSLYSGC RLTLLRPEKD
10601  GAATRVDAVC THRPDPKSPG LDRERLYWKL SQLTHGITEL GPYTLDRHSL
10651  YVNGFTHQSS MTTTRTPDTS TMHLATSRTP ASLSGPTTAS PLLVLFTINF
10701  TITNLRYEEN MHHPGSRKFN TTERVLQGLL RPVFKNTSVG PLYSGCRLTL
10751  LRPKKDGAAT KVDAICTYRP DPKSPGLDRE QLYWELSQLT HSITELGPYT
10801  QDRDSLYNVG FTQRSSVPTT SVPGTPTVDL GTSGTPVSKP GPSAASPLLV
10851  LFTLNGTITN LRYEENMQHP GSRKFNTTER VLQGLLRSLF KSTSVGPLYS
10901  GCRLTLLRPE KDGTATGVDA ICTHHPDPKS PRLDREQLYW ELSQLTHNIT
10951  ELGHYALDND SLFVNGFTHR SSVSTTSTPG TPTVYLGASK TPASIFGPSA
11001  ASHLLILFTL NFTITNLRYE ENMWPGSRKF NTTERVLQGL LRPLFKNTSV
11051  GPLYSGSRLT LLRPEKDGEA TGVDAICTHR PDPTGPGLDR EQLYLELSQL
11101  THSITELGPY TLDRDSLYVN GFTHRSSVPT TSTGVVSEEP FTLNFTINNL
11151  RYMADMGQPG SLKFNITDNV MKHLLSPLFQ RSSLGARYTG CRVIALRSVK
11201  NGAETRVDLL CTYLQPLSGP GLPIKQVFHE LSQQTHGITR LGPYSLDKDS
11251  LYLNGYNEPG LDEPPTTPKP ATTFLPPLSE ATTAMGYHLK TLTLNFTISN
11301  LQYSPDMGKG SATFNSTEGV LQHLLRPLFQ KSSMGPFYLG CQLISLRPEK
11351  DGAATGVDTT CTYHPDPVGP GLDIQQLYWE LSQLTHGVTQ LGFYVLDRDS
11401  LFINGYAPQN LSIRGEYQIN FHIVNWNLSN PDPTSSEY
```

TABLE 21-continued

CA125 Protein Sequence
(SEQ ID NO: 162)

Carboxy Terminal Domain

```
                                                    IT LLRDIQDKVT
11451  TLYKGSQLHD TFRFCLVTNL TMDSVLVTVK ALFSSNLDPS LVEQVFLDKT

11501  LNASFHWLGS TYQLVDIHVT EMESSVYQPT SSSSTQHFYL NFTITNLPYS

11551  QDKAQPGTTN YQRNKRNIED ALNQLFRNSS IKSYFSDCQV STFRSVPNRH

11601  HTGVDSLCNF SPLARRVDRV AIYEEFLRMT RNGTQLQNFT LDRSSVLVDG

11651  YSPNRNEPLT GNSDLPFWAV ILIGLAGLLG LITCLICGVL VTTRRRKKEG

11701  EYNVQQQCPG YYQSHLDLED LQ
```

TABLE 22

CA125 Repeat Nucleotide Sequence
(SEQ ID NO: 307)

```
  1  ACTGCTGGCC CTCTCCTGGT GCCATTCACC CTCAACTTCA CCATCACCAA

51  CCTGCAGTAT GAGGAGGACA TGCATCGCCC TGGATCTAGG AAGTTCAACA

101  CCACAGAGAG GGTCCTGCAG GGTCTGCTTA GTCCCATATT CAAGAACACC

151  AGTGTTGGCC CTCTGTACTC TGGCTGCAGA CTGACCTCTC TCAGGTCTGA

201  GAAGGATGGA GCAGCCACTG GAGTGGATGC CATCTGCATC CATCATCTTG

251  ACCCCAAAAG CCCTGGACTC AACAGAGAGC GGCTGTACTG GGAGCTGAGC

301  CGACTGACCA ATGGCATCAA AGAGCTGGGC CCCTACACCC TGGACAGGAA

351  CAGTCTCTAT GTCAATGGTT TCACCCATCG GACCTCTGTG CCCACCACCA

401  GCACTCCTGG GACCTCCACA GTGGACCTTG GAACCTCAGG GACTCCATTC

451  TCCCTCCCAA GCCCCGCA
```

TABLE 23

CA125 Repeat Amino Acid Sequence
(SEQ ID NO: 308)

```
  1  TAGPLLVPFT LNFTITNLQY EEDMHRPGSR KFNTTERVLQ GLLSPIFKNT

51  SVGPLYSGCR LTSLRSEKDG AATGVDAICI HHLDPKSPGL NRERLYWELS

101  RLTNGIKELG PYTLDRNSLY VNGFTHRTSV PTTSTPGTST VDLGTSGTPF

151  SLPSPA
```

TABLE 24

DNA Sequence of the CA125 Amino Terminal Extension
(SEQ ID NO: 309)

```
  1  AAGCGTTGCA CAATTCCCCC AACCTCCATA CATACGGCAG CTCTTCTAGA

51  CACAGGTTTT CCCAGGTCAA ATGCGGGGAC CCCAGCCATA TCTCCCACCC

101  TGAGAAATTT TGGAGTTTCA GGGAGCTCAG AAGCTCTGCA GAGGCCACCC

151  TCTCTGAGGG GATTCTTCTT AGACCTCCAT CCAGAGGCAA ATGTTGACCT

201  GTCCATGCTG AAACCCTCAG GCCTTCCTGG GTCATCTTCT CCCACCCGCT

251  CCTTGATGAC AGGGAGCAGG AGCACTAAAG CCACACCAGA AATGGATTCA
```

TABLE 24-continued

DNA Sequence of the CA125 Amino Terminal Extension
(SEQ ID NO: 309)

```
 301    GGACTGACAG GAGCCACCTT GTCACCTAAG ACATCTACAG GTGCAATCGT
 351    GGTGACAGAA CATACTCTGC CCTTTACTTC CCCAGATAAG ACCTTGGCCA
 401    GTCCTACATC TTCGGTTGTG GGAAGAACCA CCCAGTCTTT GGGGGTGATG
 451    TCCTCTGCTC TCCCTGAGTC AACCTCTAGA GGAATGACAC ACTCCGAGCA
 501    AAGAACCAGC CCATCGCTGA GTCCCCAGGT CAATGGAACT CCCTCTAGGA
 551    ACTACCCTGC TACAAGCATG GTTTCAGGAT TGAGTTCCCC AAGGACCAGG
 601    ACCAGTTCCA CAGAAGGAAA TTTTACCAAA GAAGCATCTA CATACACACT
 651    CACTGTAGAG ACCACAAGTG GCCCAGTCAC TGAGAAGTAC ACAGTCCCCA
 701    CTGAGACCTC AACAACTGAA GGTGACAGCA CAGAGACCCC CTGGGACACA
 751    AGATATATTC CTGTAAAAAT CACATCTCCA ATGAAAACAT TTGCAGATTC
 801    AACTGCATCC AAGGAAAATG CCCCAGTGTC TATGACTCCA GCTGAGACCA
 851    CAGTTACTGA CTCACATACT CCAGGAAGGA CAAACCCATC ATTTGGGACA
 901    CTTTATTCTT CCTTCCTTGA CCTATCACCT AAAGGGACCC CAAATTCCAG
 951    AGGTGAAACA AGCCTGGAAC TGATTCTATC AACCACTGGA TATCCCTTCT
1001    CCTCTCCTGA ACCTGGCTCT GCAGGACACA GCAGAATAAG TACCAGTGCG
1051    CCTTTGTCAT CATCTGCTTC AGTTCTCGAT AATAAAATAT CAGAGACCAG
1101    CATATTCTCA GGCCAGAGTC TCACCTCCCC TCTGTCTCCT GGGGTGCCCG
1151    AGGCCAGAGC CAGCACAATG CCCAACTCAG CTATCCCTTT TTCCATGACA
1201    CTAAGCAATG CAGAAACAAG TGCCGAAAGG GTCAGAAGCA CAATTTCCTC
1251    TCTGGGGACT CCATCAATAT CCACAAAGCA GACAGCAGAG ACTATCCTTA
1301    CCTTCCATGC CTTCGCTGAG ACCATGGATA TACCCAGCAC CCACATAGCC
1351    AAGACTTTGG CTTCAGAATG GTTGGGAAGT CCAGGTACCC TTGGTGGCAC
1401    CAGCACTTCA GCGCTGACAA CCACATCTCC ATCTACCACT TTAGTCTCAG
1451    AGGAGACCAA CACCCATCAC TCCACGAGTG GAAAGGAAAC AGAAGGAACT
1501    TTGAATACAT CTATGACTCC ACTTGAGACC TCTGCTCCTG GAGAAGAGTC
1551    CGAAATGACT GCCACCTTGG TCCCCACTCT AGGTTTTACA ACTCTTGACA
1601    GCAAGATCAG AAGTCCATCT CAGGTCTCTT CATCCCACCC AACAAGAGAG
1651    CTCAGAACCA CAGGCAGCAC CTCTGGGAGG CAGAGTTCCA GCACAGCTGC
1701    CCACGGGAGC TCTGACATCC TGAGGGCAAC CACTTCCAGC ACCTCAAAAG
1751    CATCATCATG GACCAGTGAA AGCACAGCTC AGCAATTTAG TGAACCCCAG
1801    CACACACAGT GGGTGGAGAC AAGTCCTAGC ATGAAAACAG AGAGACCCCC
1851    AGCATCAACC AGTGTGGCAG CCCCTATCAC CACTTCTGTT CCCTCAGTGG
1901    TCTCTGGCTT CACCACCCTG AAGACCAGCT CCACAAAAGG GATTTGGCTT
1951    GAAGAAACAT CTGCAGACAC ACTCATCGGA GAATCCACAG CTGGCCCAAC
2001    CACCCATCAG TTTGCTGTTC CCACTGGGAT TCAATGACA GGAGGCAGCA
2051    GCACCAGGGG AAGCCAGGGC ACAACCCACC TACTCACCAG AGCCACAGCA
2101    TCATCTGAGA CATCCGCAGA TTTGACTCTG GCCACGAACG GTGTCCCAGT
2151    CTCCGTGTCT CCAGCAGTGA GCAAGACGGC TGCTGGCTCA AGTCCTCCAG
2201    GAGGGACAAA GCCATCATAT ACAATGGTTT CTTCTGTCAT CCCTGAGACA
```

TABLE 24-continued

DNA Sequence of the CA125 Amino Terminal Extension
(SEQ ID NO: 309)

```
2251  TCATCTCTAC AGTCCTCAGC TTTCAGGGAA GGAACCAGCC TGGGACTGAC
2301  TCCATTAAAC ACTAGACATC CCTTCTCTTC CCCTGAACCA GACTCTGCAG
2351  GACACACCAA GATAAGCACC AGCATTCCTC TGTTGTCATC TGCTTCAGTT
2401  CTTGAGGATA AAGTGTCAGC GACCAGCACA TTCTCACACC ACAAAGCCAC
2451  CTCATCTATT ACCACAGGGA CTCCTGAAAT CTCAACAAAG ACAAAGCCCA
2501  GCTCAGCCGT TCTTTCCTCC ATGACCCTAA GCAATGCAGC AACAAGTCCT
2551  GAAAGAGTCA GAAATGCAAC TTCCCCTCTG ACTCATCCAT CTCCATCAGG
2601  GGAAGAGACA GCAGGGAGTG TCCTCACTCT CAGCACCTCT GCTGAGACTA
2651  CAGACTCACC TAACATCCAC CCAACTGGGA CACTGACTTC AGAATCGTCA
2701  GAGAGTCCTA GCACTCTCAG CCTCCCAAGT GTCTCTGGAG TCAAAACCAC
2751  ATTTTCTTCA TCTACTCCTT CCACTCATCT ATTTACTAGT GGAGAAGAAA
2801  CAGAGGAAAC TTCGAATCCA TCTGTGTCTC AACCTGAGAC TTCTGTTTCC
2851  AGAGTAAGGA CCACCTTGGC CAGCACCTCT GTCCCTACCC CAGTATTCCC
2901  CACCATGGAC ACCTGGCCTA CACGTTCAGC TCAGTTCTCT TCATCCCACC
2951  TAGTGAGTGA GCTCAGAGCT ACGAGCAGTA CCTCAGTTAC AAACTCAACT
3001  GGTTCAGCTC TTCCTAAAAT ATCTCACCTC ACTGGGACGG CAACAATGTC
3051  ACAGACCAAT AGAGACACGT TTAATGACTC TGCTGCACCC CAAAGCACAA
3101  CTTGGCCAGA GACTAGTCCC AGATTCAAGA CAGGGTTACC TTCAGCAACA
3151  ACCACTGTTT CAACCTCTGC CACTTCTCTC TCTGCTACTG TAATGGTCTC
3201  TAAATTCACT TCTCCAGCAA CTAGTTCCAT GGAAGCAACT TCTATCAGGG
3251  AACCATCAAC AACCATCCTC ACAACAGAGA CCACGAATGG CCCAGGCTCT
3301  ATGGCTGTGG CTTCTACCAA CATCCCAATT GGAAAGGGCT ACATTACTGA
3351  AGGAAGATTG GACACAAGCC ATCTGCCCAT TGGAACCACA GCTTCCTCTG
3401  AGACATCTAT GGATTTTACC ATGGCCAAAG AAAGTGTCTC AATGTCAGTA
3451  TCTCCATCTC AGTCCATGGA TGCTGCTGGC TCAAGCACTC AGGAAGGAC
3501  AAGCCAATTC GTTGACACAT TTTCTGATGA TGTCTATCAT TTAACATCCA
3551  GAGAAATTAC AATACCTAGA GATGGAACAA GCTCAGCTCT GACTCCACAA
3601  ATGACTGCAA CTCACCCTCC ATCTCCTGAT CCTGGCTCTG CTAGAAGCAC
3651  CTGGCTTGGC ATCTTGTCCT CATCTCCTTC TTCTCCTACT CCCAAAGTCA
3701  CAATGAGCTC ACATTTTCA ACTCAGAGAG TCACCACAAG CATGATAATG
3751  GACACAGTTG AAACTAGTCG GTGGAACATG CCCAACTTAC CTTCCACGAC
3801  TTCCCTGACA CCAAGTAATA TTCCAACAAG TGGTGCCATA GGAAAAAGCA
3851  CCCTGGTTCC CTTGGACACT CCATCTCCAG CCACATCATT GGAGGCATCA
3901  GAAGGGGAC TTCCAACCCT CAGCACCTAC CCTGAATCAA CAAACACACC
3951  CAGCATCCAC CTCGGAGCAC ACGCTAGTTC AGAAAGTCCA AGCACCATCA
4001  AACTTACCAT GGCTTCAGTA GTAAAACCTG GCTCTTACAC ACCTCTCACC
4051  TTCCCCTCAA TAGAGACCCA CATTCATGTA TCAACAGCCA GAATGGCTTA
4101  CTCTTCTGGG TCTTCACCTG AGATGACAGC TCCTGGAGAG ACTAACACTG
```

TABLE 24-continued

DNA Sequence of the CA125 Amino Terminal Extension
(SEQ ID NO: 309)

| | |
|---|---|
| 4151 | GTAGTACCTG GGACCCCACC ACCTACATCA CCACTACGGA TCCTAAGGAT |
| 4201 | ACAAGTTCAG CTCAGGTCTC TACACCCCAC TCAGTGAGGA CACTCAGAAC |
| 4251 | CACAGAAAAC CATCCAAAGA CAGAGTCCGC CACCCCAGCT GCTTACTCTG |
| 4301 | GAAGTCCTAA AATCTCAAGT TCACCCAATC TCACCAGTCC GGCCACAAAA |
| 4351 | GCATGGACCA TCACAGACAC AACTGAACAC TCCACTCAAT TACATTACAC |
| 4401 | AAAATTGGCA GAAAAATCAT CTGGATTTGA GACACAGTCA GCTCCAGGAC |
| 4451 | CTGTCTCTGT AGTAATCCCT ACCTCCCCTA CCATTGGAAG CAGCACATTG |
| 4501 | GAACTAACTT CTGATGTCCC AGGGGAACCC CTGGTCCTTG CTCCCAGTGA |
| 4551 | GCAGACCACA ATCACTCTCC CCATGGCAAC ATGGCTGAGT ACCAGTTTGA |
| 4601 | CAGAGGAAAT GGCTTCAACA GACCTTGATA TTTCAAGTCC AAGTTCACCC |
| 4651 | ATGAGTACAT TTGCTATTTT TCCACCTATG TCCACACCTT CTCATGAACT |
| 4701 | TTCAAAGTCA GAGGCAGATA CCAGTGCCAT TAGAAATACA GATTCAACAA |
| 4751 | CGTTGGATCA GCACCTAGGA ATCAGGAGTT TGGGCAGAAC TGGGGACTTA |
| 4801 | ACAACTGTTC CTATCACCCC ACTGACAACC ACGTGGACCA GTGTGATTGA |
| 4851 | ACACTCAACA CAAGCACAGG ACACCCTTTC TGCAACGATG AGTCCTACTC |
| 4901 | ACGTGACACA GTCACTCAAA GATCAAACAT CTATACCAGC CTCAGCATCC |
| 4951 | CCTTCCCATC TTACTGAAGT CTACCCTGAG CTCGGGACAC AAGGGAGAAG |
| 5001 | CTCCTCTGAG GCAACCACTT TTTGGAAACC ATCTACAGAC ACACTGTCCA |
| 5051 | GAGAGATTGA GACTGGCCCA ACAAACATTC AATCCACTCC ACCCATGGAC |
| 5101 | AACACAACAA CAGGGAGCAG TAGTAGTGGA GTCACCCTGG CATAGCCCA |
| 5151 | CCTTCCCATA GGAACATCCT CCCCAGCTGA GACATCCACA AACATGGCAC |
| 5201 | TGGAAAGAAG AAGTTCTACA GCCACTGTCT CTATGGCTGG GACAATGGGA |
| 5251 | CTCCTTGTTA CTAGTGCTCC AGGAAGAAGC ATCAGCCAGT CATTAGGAAG |
| 5301 | AGTTTCCTCT GTCCTTTCTG AGTCAACTAC TGAAGGAGTC ACAGATTCTA |
| 5351 | GTAAGGGAAG CAGCCCAAGG CTGAACACAC AGGGAAATAC AGCTCTCTCC |
| 5401 | TCCTCTCTTG AACCCAGCTA TGCTGAAGGA AGCCAGATGA GCACAAGCAT |
| 5451 | CCCTCTAACC TCATCTCCTA CAACTCCTGA TGTGGAATTC ATAGGGGGCA |
| 5501 | GCACATTTTG GACCAAGGAG GTCACCACAG TTATGACCTC AGACATCTCC |
| 5551 | AAGTCTTCAG CAAGGACAGA GTCCAGCTCA GCTACCCTTA TGTCCACAGC |
| 5601 | TTTGGGAAGC ACTGAAAATA CAGGAAAAGA AAAACTCAGA ACTGCCTCTA |
| 5651 | TGGATCTTCC ATCTCCAACT CCATCAATGG AGGTGACACC ATGGATTTCT |
| 5701 | CTCACTCTCA GTAATGCCCC CAATACCACA GATTCACTTG ACCTCAGCCA |
| 5751 | TGGGGTGCAC ACCAGCTCTG CAGGGACTTT GGCCACTGAC AGGTCATTGA |
| 5801 | ATACTGGTGT CACTAGAGCC TCCAGATTGG AAAACGGCTC TGATACCTCT |
| 5851 | TCTAAGTCCC TGTCTATGGG AAACAGCACT CACACTTCCA TGACTGACAC |
| 5901 | AGAGAAGAGT GAAGTGTCTT CTTCAATCCA TCCCCGACCT GAGACCTCAG |
| 5951 | CTCCTGGAGC AGAGACCACT TTGACTTCCA CTCCTGGAAA CAGGGCCATA |
| 6001 | AGCTTAACAT TGCCTTTTTC ATCCATTCCA GTGGAAGAAG TCATTTCTAC |
| 6051 | AGGCATAACC TCAGGACCAG ACATCAACTC AGCACCCATG ACACATTCTC |

TABLE 24-continued

DNA Sequence of the CA125 Amino Terminal Extension
(SEQ ID NO: 309)

```
6101   CCATCACCCC ACCAACAATT GTATGGACCA GTACAGGCAC AATTGAACAG
6151   TCCACTCAAC CACTACATGC AGTTTCTTCA GAAAAAGTTT CTGTGCAGAC
6201   ACAGTCAACT CCATATGTCA ACTCTGTGGC AGTGTCTGCT TCCCCTACCC
6251   ATGAGAATTC AGTCTCTTCT GGAAGCAGCA CATCCTCTCC ATATTCCTCA
6301   GCCTCACTTG AATCCTTGGA TTCCACAATC AGTAGGAGGA ATGCAATCAC
6351   TTCCTGGCTA TGGGACCTCA CTACATCTCT CCCCACTACA ACTTGGCCAA
6401   GTACTAGTTT ATCTGAGGCA CTGTCCTCAG GCCATTCTGG GGTTTCAAAC
6451   CCAAGTTCAA CTACGACTGA ATTTCCACTC TTTTCAGCTG CATCCACATC
6501   TGCTGCTAAG CAAAGAAATC AGAAACAGA GACCCATGGT CCCCAGAATA
6551   CAGCCGCGAG TACTTTGAAC ACTGATGCAT CCTCGGTCAC AGGTCTTTCT
6601   GAGACTCCTG TGGGGCAAG TATCAGCTCT GAAGTCCCTC TTCCAATGGC
6651   CATAACTTCT AGATCAGATG TTTCTGGCCT TACATCTGAG AGTACTGCTA
6701   ACCCGAGTTT AGGCACAGCC TCTTCAGCAG GGACCAAATT AACTAGGACA
6751   ATATCCCTGC CCACTTCAGA GTCTTTGGTT TCCTTTAGAA TGAACAAGGA
6801   TCCATGGACA GTGTCAATCC CTTTGGGGTC CCATCCAACT ACTAATACAG
6851   AAACAAGCAT CCCAGTAAAC AGCGCAGGTC CACCTGGCTT GTCCACAGTA
6901   GCATCAGATG TAATTGACAC ACCTTCAGAT GGGGCTGAGA GTATTCCCAC
6951   TGTCTCCTTT TCCCCCTCCC CTGATACTGA AGTGACAACT ATCTCACATT
7001   TCCCAGAAAA GACAACTCAT TCATTTAGAA CCATTTCATC TCTCACTCAT
7051   GAGTTGACTT CAAGAGTGAC ACCTATTCCT GGGGATTGGA TGAGTTCAGC
7101   TATGTCTACA AAGCCCACAG GAGCCAGTCC CTCCATTACA CTGGGAGAGA
7151   GAAGGACAAT CACCTCTGCT GCTCCAACCA CTTCCCCCAT AGTTCTCACT
7201   GCTAGTTTCA CAGAGACCAG CACAGTTTCA CTGGATAATG AAACTACAGT
7251   AAAAACCTCA GATATCCTTG ACGCACGGAA AACAAATGAG CTCCCCTCAG
7301   ATAGCAGTTC TTCTTCTGAT CTGATCAACA CCTCCATAGC TTCTTCAACT
7351   ATGGATGTCA CTAAAACAGC CTCCATCAGT CCCACTAGCA TCTCAGGAAT
7401   GACAGCAAGT TCCTCCCCAT CTCTCTTCTC TTCAGATAGA CCCCAGGTTC
7451   CCACATCTAC AACAGAGACA AATACAGCCA CCTCTCCATC TGTTTCCAGT
7501   AACACCTATT CTCTTGATGG GGGCTCCAAT GTGGGTGGCA CTCCATCCAC
7551   TTTACCACCC TTTACAATCA CCCACCCTGT CGAGACAAGC TCGGCCCTAT
7601   TAGCCTGGTC TAGACCAGTA AGAACTTTCA GCACCATGGT CAGCACTGAC
7651   ACTGCCTCCG GAGAAAATCC TACCTCTAGC AATTCTGTGG TGACTTCTGT
7701   TCCAGCACCA GGTACATGGA CCAGTGTAGG CAGTACTACT GACTTACCTG
7751   CCATGGGCTT TCTCAAGACA AGTCCTGCAG GAGAGGCACA CTCACTTCTA
7801   GCATCAACTA TTGAACCAGC CACTGCCTTC ACTCCCCATC TCTCAGCAGC
7851   AGTGGTCACT GGATCCAGTG CTACATCAGA AGCCAGTCTT CTCACTACGA
7901   GTGAAAGCAA AGCCATTCAT TCTTCACCAC AGACCCCAAC TACACCCACC
7951   TCTGGAGCAA ACTGGGAAAC TTCAGCTACT CCTGAGAGCC TTTTGGTAGT
```

TABLE 24-continued

DNA Sequence of the CA125 Amino Terminal Extension
(SEQ ID NO: 309)

| | |
|---|---|
| 8001 | CACTGAGACT TCAGACACAA CACTTACCTC AAAGATTTTG GTCACAGATA |
| 8051 | CCATCTTGTT TTCAACTGTG TCCACGCCAC CTTCTAAATT TCCAAGTACG |
| 8101 | GGGACTCTGT CTGGAGCTTC CTTCCCTACT TTACTCCCGG ACACTCCAGC |
| 8151 | CATCCCTCTC ACTGCCACTG AGCCAACAAG TTCATTAGCT ACATCCTTTG |
| 8201 | ATTCCACCCC ACTGGTGACT ATAGCTTCGG ATAGTCTTGG CACAGTCCCA |
| 8251 | GAGACTACCC TGACCATGTC AGAGACCTCA AATGGTGATG CACTGGTTCT |
| 8301 | TAAGACAGTA AGTAACCCAG ATAGGAGCAT CCCTGGAATC ACTATCCAAG |
| 8351 | GAGTAACAGA AAGTCCACTC CATCCTTCTT CCACTTCCCC CTCTAAGATT |
| 8401 | GTTGCTCCAC GGAATACAAC CTATGAAGGT TCGATCACAG TGGCACTTTC |
| 8451 | TACTTTGCCT GCGGGAACTA CTGGTTCCCT TGTATTCAGT CAGAGTTCTG |
| 8501 | AAAACTCAGA GACAACGGCT TTGGTAGACT CATCAGCTGG GCTTGAGAGG |
| 8551 | GCATCTGTGA TGCCACTAAC CACAGGAAGC CAGGGTATGG CTAGCTCTGG |
| 8601 | AGGAATCAGA AGTGGGTCCA CTCACTCAAC TGGAACCAAA ACATTTTCTT |
| 8651 | CTCTCCCTCT GACCATGAAC CCAGGTGAGG TTACAGCCAT GTCTGAAATC |
| 8701 | ACCACGAACA GACTGACAGC TACTCAATCA ACAGCACCCA AAGGGATACC |
| 8751 | TGTGAAGCCC ACCAGTGCTG AGTCAGGCCT CCTAACACCT GTCTCTGCCT |
| 8801 | CCTCAAGCCC ATCAAAGGCC TTTGCCTCAC TGACTACAGC TCCCCCAACT |
| 8851 | TGGGGGATCC CACAGTCTAC CTTGACATTT GAGTTTTCTG AGGTCCCAAG |
| 8901 | TTTGGATACT AAGTCCGCTT CTTTACCAAC TCCTGGACAG TCCCTGAACA |
| 8951 | CCATTCCAGA CTCAGATGCA AGCACAGCAT CTTCCTCACT GTCCAAGTCT |
| 9001 | CCAGAAAAAA ACCCAAGGGC AAGGATGATG ACTTCCACAA AGGCCATAAG |
| 9051 | TGCAAGCTCA TTTCAATCAA CAGGTTTTAC TGAAACCCCT GAGGGATCTG |
| 9101 | CCTCCCCTTC TATGGCAGGG CATGAACCCA GAGTCCCCAC TTCAGGAACA |
| 9151 | GGGGACCCTA GATATGCCTC AGAGAGCATG TCTTATCCAG ACCCAAGCAA |
| 9201 | GGCATCATCA GCTATGACAT CGACCTCTCT TGCATCAAAA CTCACAACTC |
| 9251 | TCTTCAGCAC AGGTCAAGCA GCAAGGTCTG GTTCTAGTTC CTCTCCCATA |
| 9301 | AGCCTATCCA CTGAGAAAGA AACAAGCTTC CTTTCCCCCA CTGCATCCAC |
| 9351 | CTCCAGAAAG ACTTCACTAT TTCTTGGGCC TTCCATGGCA AGGCAGCCCA |
| 9401 | ACATATTGGT GCATCTTCAG ACTTCAGCTC TGACACTTTC TCCAACATCC |
| 9451 | ACTCTAAATA TGTCCCAGGA GGAGCCTCCT GAGTTAACCT CAAGCCAGAC |
| 9501 | CATTGCAGAA GAAGAGGGAA CAACAGCTGA ACACAGACG TTAACCTTCA |
| 9551 | CACCATCTGA GACCCCAACA TCCTTGTTAC CTGTCTCTTC TCCCACAGAA |
| 9601 | CCCACAGCCA GAAGAAAGAG TTCTCCAGAA ACATGGGCAA GCTCTATTTC |
| 9651 | AGTTCCTGCC AAGACCTCCT TGGTTGAAAC AACTGATGGA ACGCTAGTGA |
| 9701 | CCACCATAAA GATGTCAAGC AGGCAGCAC AAGGAAATTC CACGTGGCCT |
| 9751 | GCCCCAGCAG AGGAGACGGG GACCAGTCCA GCAGGCACAT CCCCAGGAAG |
| 9801 | CCCAGAAATG TCTACCACTC TCAAAATCAT GAGCTCCAAG GAACCCAGCA |
| 9851 | TCAGCCCAGA GATCAGGTCC ACTGTGCGAA ATTCTCCTTG GAAGACTCCA |
| 9901 | GAAACAACTG TTCCCATGGA GACCACAGTG GAACCAGTCA CCCTTCAGTC |

TABLE 24-continued

DNA Sequence of the CA125 Amino Terminal Extension
(SEQ ID NO: 309)

```
 9951   CACAGCCCTA GGAAGTGGCA GCACCAGCAT CTCTCACCTG CCCACAGGAA
10001   CCACATCACC AACCAAGTCA CCAACAGAAA ATATGTTGGC TACAGAAAGG
10051   GTCTCCCTCT CCCCATCCCC ACCTGAGGCT TGGACCAACC TTTATTCTGG
10101   AACTCCAGGA GGGACCAGGC AGTCACTGGC ACAATGTCC TCTGTCTCCC
10151   TAGAGTCACC AACTGCTAGA AGCATCACAG GGACTGGTCA GCAAAGCAGT
10201   CCAGAACTGG TTTCAAAGAC AACTGGAATG GAATTCTCTA TGTGGCATGG
10251   CTCTACTGGA GGGACCACAG GGGACACACA TGTCTCTCTG AGCACATCTT
10301   CCAATATCCT TGAAGACCCT GTAACCAGCC CAAACTCTGT GAGCTCATTG
10351   ACAGATAAAT CCAAACATAA AACCGAGACA TGGGTAAGCA CCACAGCCAT
10401   TCCCTCCACT GTCCTGAATA ATAAGATAAT GGCAGCTGAA CAACAGACAA
10451   GTCGATCTGT GGATGAGGCT TATTCATCAA CTAGTTCTTG GTCAGATCAG
10501   ACATCTGGGA GTGACATCAC CCTTGGTGCA TCTCCTGATG TCACAAACAC
10551   ATTATACATC ACCTCCACAG CACAAACCAC CTCACTAGTG TCTCTGCCCT
10601   CTGGAGACCA AGGCATTACA AGCCTCACCA ATCCCTCAGG AGGAAAAACA
10651   AGCTCTGCGT CATCTGTCAC ATCTCCTTCA ATAGGGCTTG AGACTCTGAG
10701   GGCCAATGTA AGTGCAGTGA AAAGTGACAT TGCCCCTACT GCTGGGCATC
10751   TATCTCAGAC TTCATCTCCT GCGGAAGTGA GCATCCTGGA CGTAACCACA
10801   GCTCCTACTC CAGGTATCTC CACCACCATC ACCACCATGG GAACCAACTC
10851   AATCTCAACT ACCACACCCA ACCCAGAAGT GGGTATGAGT ACCATGGACA
10901   GCACCCCGGC ACAGAGAGG CGCACAACTT CTACAGAACA CCCTTCCACC
10951   TGGTCTTCCA CAGCTGCATC AGATTCCTGG ACTGTCACAG ACATGACTTC
11001   AAACTTGAAA GTTGCAAGAT CTCCTGGAAC AATTTCCACA ATGCATACAA
11051   CTTCATTCTT AGCCTCAAGC ACTGAATTAG ACTCCATGTC TACTCCCCAT
11101   GGCCGTATAA CTGTCATTGG AACCAGCCTG GTCACTCCAT CCTCTGATGC
11151   TTCAGCTGTA AAGACAGAGA CCAGTACAAG TGAAAGAACA TTGAGTCCTT
11201   CAGACACAAC TGCATCTACT CCCATCTCAA CTTTTTCTCG TGTCCAGAGG
11251   ATGAGCATCT CAGTTCCTGA CATTTTAAGT ACAAGTTGGA CTCCCAGTAG
11301   TACAGAAGCA GAAGATGTGC CTGTTTCAAT GGTTTCTACA GATCATGCTA
11351   GTACAAAGAC TGACCCAAAT ACGCCCCTGT CCACTTTTCT GTTTGATTCT
11401   CTGTCCACTC TTGACTGGGA CACTGGGAGA TCTCTGTCAT CAGCCACAGC
11451   CACTACCTCA GCTCCTCAGG GGGCCACAAC TCCCCAGGAA CTCACTTTGG
11501   AAACCATGAT CAGCCCAGCT ACCTCACAGT TGCCCTTCTC TATAGGGCAC
11551   ATTACAAGTG CAGTCACACC AGCTGCAATG CAAGGAGCT CTGGAGTTAC
11601   TTTTTCAAGA CCAGATCCCA CAAGCAAAAA GGCAGAGCAG ACTTCCACTC
11651   AGCTTCCCAC CACCACTTCT GCACATCCAG GGCAGGTGCC CAGATCAGCA
11701   GCAACAACTC TGGATGTGAT CCCACACACA GCAAAAACTC CAGATGCAAC
11751   TTTTCAGAGA CAAGGGCAGA CAGCTCTTAC AACAGAGGCA AGAGCTACAT
11801   CTGACTCCTG GAATGAGAAA GAAAAATCAA CCCCAAGTGC ACCTTGGATC
```

TABLE 24-continued

DNA Sequence of the CA125 Amino Terminal Extension
(SEQ ID NO: 309)

```
11851   ACTGAGATGA TGAATTCTGT CTCAGAAGAT ACCATCAAGG AGGTTACCAG

11901   CTCCTCCAGT GTATTAAAGG ACCCTGAATA CGCTGGACAT AAACTTGGAA

11951   TCTGGGACGA CTTCATCCCC AAGTTTGGAA AAGCAGCCCA TATGAGAGAG

12001   TTGCCCCTTC TGAGTCCACC ACAGGACAAA GAGGCAATTC ACCCTTCTAC

12051   AAACACAGTA GAGACCACAG GCTGGGTCAC AAGTTCCGAA CATGCTTCTC

12101   ATTCCACTAT CCCAGCCCAC TCAGCGTCAT CCAAACTCAC ATCTCCAGTG

12151   GTTACAACCT CCACCAGGGA ACAAGCAATA GTTTCTATGT CAACAACCAC

12201   ATGGCCAGAG TCTACAAGGG CTAGAACAGA GCCTAATTCC TTCTTGACTA

12251   TTGAACTGAG GGACGTCAGC CCTTACATGG ACACCAGCTC AACCACACAA

12301   ACAAGTATTA TCTCTTCCCC AGGTTCCACT GCGATCACCA AGGGGCCTAG

12351   AACAGAAATT ACCTCCTCTA AGAGAATATC CAGCTCATTC CTTGCCCAGT

12401   CTATGAGGTC GTCAGACAGC CCCTCAGAAG CCATCACCAG GCTGTCTAAC

12451   TTTCCTGCCA TGACAGAATC TGGAGGAATG ATCCTTGCTA TGCAAACAAG

12501   TCCACCTGGC GCTACATCAC TAAGTGCACC TACTTTGGAT ACATCAGCCA

12551   CAGCCTCCTG GACAGGGACT CCACTGGCTA CGACTCAGAG ATTTACATAC

12601   TCAGAGAAGA CCACTCTCTT TAGCAAAGGT CCTGAGGATA CATCACAGCC

12651   AAGCCCTCCC TCTGTGGAAG AAACCAGCTC TTCCTCTTCC CTGGTACCTA

12701   TCCATGCTAC AACCTCGCCT TCCAATATTT TGTTGACATC ACAAGGGCAC

12751   AGTCCCTCCT CTACTCCACC TGTGACCTCA GTTTTCTTGT CTGAGACCTC

12801   TGGCCTGGGG AAGACCACAG ACATGTCGAG GATAAGCTTG AACCTGGCA

12851   CAAGTTTACC TCCCAATTTG AGCAGTACAG CAGGTGAGGC GTTATCCACT

12901   TATGAAGCCT CCAGAGATAC AAAGGCAATT CATCATTCTG CAGACACAGC

12951   AGTGACGAAT ATGGAGGCAA CCAGTTCTGA ATATTCTCCT ATCCCAGGCC

13001   ATACAAAGCC ATCCAAAGCC ACATCTCCAT TGGTTACCTC CCACATCATG

13051   GGGGACATCA CTTCTTCCAC ATCAGTATTT GGCTCCTCCG AGACCACAGA

13101   GATTGAGACA GTGTCCTCTG TGAACCAGGG ACTTCAGGAG AGAAGCACAT

13151   CCCAGGTGGC CAGCTCTGCT ACAGAGACAA GCACTGTCAT TACCCATGTG

13201   TCTAGTGGTG ATGCTACTAC TCATGTCACC AAGACACAAG CCACTTTCTC

13251   TAGCGGAACA TCCATCTCAA GCCCTCATCA GTTTATAACT TCTACCAACA

13301   CATTTACAGA TGTGAGCACC AACCCCTCCA CCTCTCTGAT AATGACAGAA

13351   TCTTCAGGAG TGACCATCAC CACCCAAACA GGTCCTACTG GAGCTGCAAC

13401   ACAGGGTCCA TATCTCTTGG ACACATCAAC CATGCCTTAC TTGACAGAGA

13451   CTCCATTAGC TGTGACTCCA GATTTTATGC AATCAGAGAA GACCACTCTC

13501   ATAAGCAAAG GTCCCAAGGA TGTGACCTGG ACAAGCCCTC CCTCTGTGGC

13551   AGAAACCAGC TATCCCTCTT CCCTGACACC TTTCTTGGTC ACAACCATAC

13601   CTCCTGCCAC TTCCACGTTA CAAGGGCAAC ATACATCCTC TCCTGTTTCT

13651   GCGACTTCAG TTCTTACCTC TGGACTGGTG AAGACCACAG ATATGTTGAA

13701   CACAAGCATG GAACCTGTGA CCAATTCACC TCAAATTTG AACAATCCAT

13751   CAAATGAGAT ACTGGCCACT TTGGCAGCCA CCACAGATAT AGAGACTATT
```

TABLE 24-continued

DNA Sequence of the CA125 Amino Terminal Extension
(SEQ ID NO: 309)

```
13801    CATCCTTCCA TAAACAAAGC AGTGACCAAT ATGGGGACTG CCAGTTCAGC

13851    ACATGTACTG CATTCCACTC TCCCAGTCAG CTCAGAACCA TCTACAGCCA

13901    CATCTCCAAT GGTTCCTGCC TCCAGCATGG GGACGCTCT TGCTTCTATA

13951    TCAATACCTG GTTCTGAGAC CACAGACATT GAGGGAGAGC CAACATCCTC

14001    CCTGACTGCT GGACGAAAAG AGAACAGCAC CCTCCAGGAG ATGAACTCAA

14051    CTACAGAGTC AAACATCATC CTCTCCAATG TGTCTGTGGG GGCTATTACT

14101    GAAGCCACAA AAATGGAAGT CCCCTCTTTT GATGCAACAT TCATACCAAC

14151    TCCTGCTCAG TCAACAAAGT TCCCAGATAT TTTCTCAGTA GCCAGCAGTA

14201    GACTTTCAAA CTCTCCTCCC ATGACAATAT CTACCCACAT GACCACCACC

14251    CAGACAGGGT CTTCTGGAGC TACATCAAAG ATTCCACTTG CCTTAGACAC

14301    ATCAACCTTG GAAACCTCAG CAGGGACTCC ATCAGTGGTG ACTGAGGGGT

14351    TTGCCCACTC AAAAATAACC ACTGCAATGA ACAATGATGT CAAGGACGTG

14401    TCACAGACAA ACCCTCCCTT TCAGGATGAA GCCAGCTCTC CCTCTTCTCA

14451    AGCACCTGTC CTTGTCACAA CCTTACCTTC TTCTGTTGCT TTCACACCGC

14501    AATGGCACAG TACCTCCTCT CCTGTTTCTA TGTCCTCAGT TCTTACTTCT

14551    TCACTGGTAA AGACCGCAGG CAAGGTGGAT ACAAGCTTAG AAACAGTGAC

14601    CAGTTCACCT CAAAGTATGA GCAACACTTT GGATGACATA TCGGTCACTT

14651    CAGCAGCCAC CACAGATATA GAGACAACGC ATCCTTCCAT AAACACAGTA

14701    GTTACCAATG TGGGGACCAC CGGTTCAGCA TTTGAATCAC ATTCTACTGT

14751    CTCAGCTTAC CCAGAGCCAT CTAAAAGTCA CATTCTCCCA ATGTTACCAC

14801    CTCCACCATG GAAGACACCA CAATTTCCAC GATCAATACC TAAATCCTCT

14851    AAGACTACAA GAACTGAGAC TGAGACAACT TCCTCCCTGA CTCCTAAACT

14901    GAGGGAGACC AGCATCTCCC AGGAGATCAC CTCGTCCACA GAGACAAGCA

14951    CTGTTCCTTA CAAAGAGCTC ACTGGTGCCA CTACCGAGGT ATCCAGGACA

15001    GATGTCACTT CCTCTAGCAG TACATCCTTC CCTGGCCCTG ATCAGTCCAC

15051    AGTGTCACTA GACATCTCCA CAGAAACCAA CACCAGGCTG TCTACCTCCC

15101    CAATAATGAC AGAATCTGCA GAAATAACCA TCACCACCCA AACAGGTCCT

15151    CATGGGGCTA CATCACAGGA TACTTTTACC ATGGACCCAT CAAATACAAC

15201    CCCCCAGGCA GGGATCCACT CAGCTATGAC TCATGGATTT TCACAATTGG

15251    ATGTGACCAC TCTTATGAGC AGAATTCCAC AGGATGTATC ATGGACAAGT

15301    CCTCCCTCTG TGGATAAAAC CAGCTCCCCC TCTTCCTTTC TGTCCTCACC

15351    TGCAATGACC ACACCTTCCC TGATTTCTTC TACCTTACCA GAGGATAAGC

15401    TCTCCTCTCC TATGACTTCA CTTCTCACCT CTGGCCTAGT GAAGATTACA

15451    GACATATTAC GTACACGCTT GGAACCTGTG ACCAGCTCAC TTCCAAATTT

15501    CAGCAGCACC TCAGATAAGA TACTGGCCAC TTCTAAAGAC AGTAAAGACA

15551    CAAAGGAAAT TTTTCCTTCT ATAAACACAG AAGAGACCAA TGTGAAAGCC

15601    AACAACTCTG GACATGAATC CCATTCCCCT GCACTGGCTG ACTCAGAGAC

15651    ACCCAAAGCC ACAACTCAAA TGGTTATCAC CACCACTGTG GGAGATCCAG
```

TABLE 24-continued

DNA Sequence of the CA125 Amino Terminal Extension
(SEQ ID NO: 309)

```
15701    CTCCTTCCAC ATCAATGCCA GTGCATGGTT CCTCTGAGAC TACAAACATT
15751    AAGAGAGAGC CAACATATTT CTTGACTCCT AGACTGAGAG AGACCAGTAC
15801    CTCTCAGGAG TCCAGCTTTC CCACGGACAC AAGTTTTCTA CTTTCCAAAG
15851    TCCCCACTGG TACTATTACT GAGGTCTCCA GTACAGGGGT CAACTCTTCT
15901    AGCAAAATTT CCACCCCAGA CCATGATAAG TCCACAGTGC CACCTGACAC
15951    CTTCACAGGA GAGATCCCCA GGGTCTTCAC CTCCTCTATT AAGACAAAAT
16001    CTGCAGAAAT GACGATCACC ACCCAAGCAA GTCCTCCTGA GTCTGCATCG
16051    CACAGTACCC TTCCCTTGGA CACATCAACC ACACTTTCCC AGGGAGGGAC
16101    TCATTCAACT GTGACTCAGG GATTCCCATA CTCAGAGGTG ACCACTCTCA
16151    TGGGCATGGG TCCTGGGAAT GTGTCATGGA TGACAACTCC CCCTGTGGAA
16201    GAAACCAGCT CTGTGTCTTC CCTGATGTCT TCACCTGCCA TGACATCCCC
16251    TTCTCCTGTT TCCTCCACAT CACCACAGAG CATCCCCTCC TCTCCTCTTC
16301    CTGTGACTGC ACTTCCTACT TCTGTTCTGG TGACAACCAC AGATGTGTTG
16351    GGCACAACAA GCCCAGAGTC TGTAACCAGT TCACCTCCAA ATTTGAGCAG
16401    CATCACTCAT GAGAGACCGG CCACTTACAA AGACACTGCA CACACAGAAG
16451    CCGCCATGCA TCATTCCACA AACACCGCAG TGACCAATGT AGGGACTTCC
16501    GGGTCTGGAC ATAAATCACA ATCCTCTGTC CTAGCTGACT CAGAGACATC
16551    GAAAGCCACA CCTCTGATGA GTACCACCTC CACCCTGGGG GACACAAGTG
16601    TTTCCACATC AACTCCTAAT ATCTCTCAGA CTAACCAAAT TCAAACAGAG
16651    CCAACAGCAT CCCTGAGCCC TAGACTGAGG GAGAGCAGCA CGTCTGAGAA
16701    GACCAGCTCA ACAACAGAGA CAAATACTGC CTTTTCTTAT GTGCCCACAG
16751    GTGCTATTAC TCAGGCCTCC AGAACAGAAA TCTCCTCTAG CAGAACATCC
16801    ATCTCAGACC TTGATCGGCC CACAATAGCA CCCGACATCT CCACAGGAAT
16851    GATCACCAGG CTCTTCACCT CCCCCATCAT GACAAAATCT GCAGAAATGA
16901    CCGTCACCAC TCAAACAACT ACTCCTGGGG CTACATCACA GGGTATCCTT
16951    CCTTGGGACA CATCAACCAC ACTTTTCCAG GGAGGGACTC ATTCAACCGT
17001    GTCTCAGGGA TTCCCACACT CAGAGATAAC CACTCTTCGG AGCAGAACCC
17051    CTGGAGATGT GTCATGGATG ACAACTCCCC CTGTGGAAGA AACCAGCTCT
17101    GGGTTTTCCC TGATGTCACC TTCCATGACA TCCCCTTCTC CTGTTTCCTC
17151    CACATCACCA GAGAGCATCC CCTCCTCTCC TCTCCCTGTG ACTGCACTTC
17201    TTACTTCTGT TCTGGTGACA ACCACCAATG TATTGGGCAC AACAAGCCCA
17251    GAGACCGTAA CGAGTTCACC TCCAAATTTA AGCAGCCCCA CACAGGAGAG
17301    ACTGACCACT TACAAAGACA CTGCGCACAC AGAAGCCATG CATGCTTCCA
17351    TGCATACAAA CACTGCAGTG GCCAACGTCG GGACCTCCAT TTCTGGACAT
17401    GAATCACAAT CTTCTGTCCC AGCTGATTCA CACACATCCA AAGCCACATC
17451    TCCAATGGGT ATCACCTTCG CCATGGGGGA TACAAGTGTT TCTACATCAA
17501    CTCCTGCCTT CTTTGAGACT AGAATTCAGA CTGAATCAAC ATCCTCTTTG
17551    ATTCCTGGAT TAAGGGACAC CAGGACGTCT GAGGAGATCA ACACTGTGAC
17601    AGAGACCAGC ACTGTCCTTT CAGAAGTGCC CACTACTACT ACTACTGAGG
```

TABLE 24-continued

DNA Sequence of the CA125 Amino Terminal Extension
(SEQ ID NO: 309)

```
17651   TCTCCAGGAC AGAAGTTATC ACTTCCAGCA GAACAACCAT CTCAGGGCCT

17701   GATCATTCCA AAATGTCACC CTACATCTCC ACAGAAACCA TCACCAGGCT

17751   CTCCACTTTT CCTTTTGTAA CAGGATCCAC AGAAATGGCC ATCACCAACC

17801   AAACAGGTCC TATAGGGACT ATCTCACAGG CTACCCTTAC CCTGGACACA

17851   TCAAGCACAG CTTCCTGGGA AGGGACTCAC TCACCTGTGA CTCAGAGATT

17901   TCCACACTCA GAGGAGACCA CTACTATGAG CAGAAGTACT AAGGGCGTGT

17951   CATGGCAAAG CCCTCCCTCT GTGGAAGAAA CCAGTTCTCC TTCTTCCCCA

18001   GTGCCTTTAC CTGCAATAAC CTCACATTCA TCTCTTTATT CCGCAGTATC

18051   AGGAAGTAGC CCCACTTCTG CTCTCCCTGT GACTTCCCTT CTCACCTCTG

18101   GCAGGAGGAA GACCATAGAC ATGTTGGACA CACACTCAGA ACTTGTGACC

18151   AGCTCCTTAC CAAGTGCAAG TAGCTTCTCA GGTGAGATAC TCACTTCTGA

18201   AGCCTCCACA AATACAGAGA CAATTCACTT TTCAGAGAAC ACAGCAGAAA

18251   CCAATATGGG GACCACCAAT TCTATGCATA AACTACATTC CTCTGTCTCA

18301   ATCCACTCCC AGCCATCCGG ACACACACCT CCAAAGGTTA CTGGATCTAT

18351   GATGGAGGAC GCTATTGTTT CCACATCAAC ACCTGGTTCT CCTGAGACTA

18401   AAAATGTTGA CAGAGACTCA ACATCCCCTC TGACTCCTGA ACTGAAAGAG

18451   GACAGCACCG CCCTGGTGAT GAACTCAACT ACAGAGTCAA ACACTGTTTT

18501   CTCCAGTGTG TCCCTGGATG CTGCTACTGA GGTCTCCAGG GCAGAAGTCA

18551   CCTACTATGA TCCTACATTC ATGCCAGCTT CTGCTCAGTC AACAAAGTCC

18601   CCAGACATTT CACCTGAAGC CAGCAGCAGT CATTCTAACT CTCCTCCCTT

18651   GACAATATCT ACACACAAGA CCATCGCCAC ACAAACAGGT CCTTCTGGGG

18701   TGACATCTCT TGGCCAACTG ACCCTGGACA CATCAACCAT AGCCACCTCA

18751   GCAGGAACTC CATCAGCCAG AACTCAGGAT TTTGTAGATT CAGAAACAAC

18801   CAGTGTCATG AACAATGATC TCAATGATGT GTTGAAGACA AGCCCTTTCT

18851   CTGCAGAAGA AGCCAACTCT CTCTCTTCTC AGGCACCTCT CCTTGTGACA

18901   ACCTCACCTT CTCCTGTAAC TTCCACATTG CAAGAGCACA GTACCTCCTC

18951   TCTTGTTTCT GTGACCTCAG TACCCACCCC TACACTGGCG AAGATCACAG

19001   ACATGGACAC AAACTTAGAA CCTGTGACTC GTTCACCTCA AAATTTAAGG

19051   AACACCTTGG CCACTTCAGA AGCCACCACA GATACACACA CAATGCATCC

19101   TTCTATAAAC ACAGCAATGG CCAATGTGGG GACCACCAGT TCACCAAATG

19151   AATTCTATTT TACTGTCTCA CCTGACTCAG ACCCATATAA AGCCACATCC

19201   GCAGTAGTTA TCACTTCCAC CTCGGGGGAC TCAATAGTTT CCACATCAAT

19251   GCCTAGATCC TCTGCGATGA AAAAGATTGA GTCTGAGACA ACTTTCTCCC

19301   TGATATTTAG ACTGAGGGAG ACTAGCACCT CCCAGAAAAT TGGCTCATCC

19351   TCAGACACAA GCACGGTCTT TGACAAAGCA TTCACTGCTG CTACTACTGA

19401   GGTCTCCAGA ACAGAACTCA CCTCCTCTAG CAGAACATCC ATCCAAGGCA

19451   CTGAAAAGCC CACAATGTCA CCGGACACCT CCACAAGATC TGTCACCATG

19501   CTTTCTACTT TTGCTGGCCT GACAAAATCC GAAGAAAGGA CCATTGCCAC
```

TABLE 24-continued

DNA Sequence of the CA125 Amino Terminal Extension
(SEQ ID NO: 309)

| | |
|---|---|
| 19551 | CCAAACAGGT CCTCATAGGG CGACATCACA GGGTACCCTT ACCTGGGACA |
| 19601 | CATCAATCAC AACCTCACAG GCAGGGACCC ACTCAGCTAT GACTCATGGA |
| 19651 | TTTTCACAAT TAGATTTGTC CACTCTTACG AGTAGAGTTC CTGAGTACAT |
| 19701 | ATCAGGGACA AGCCCACCCT CTGTGGAAAA AACCAGCTCT TCCTCTTCCC |
| 19751 | TTCTGTCTTT ACCAGCAATA ACCTCACCGT CCCCTGTACC TACTACATTA |
| 19801 | CCAGAAAGTA GGCCGTCTTC TCCTGTTCAT CTGACTTCAC TCCCCACCTC |
| 19851 | TGGCCTAGTG AAGACCACAG ATATGCTGGC ATCTGTGGCC AGTTTACCTC |
| 19901 | CAAACTTGGG CAGCACCTCA CATAAGATAC CGACTACTTC AGAAGACATT |
| 19951 | AAAGATACAG AGAAAATGTA TCCTTCCACA AACATAGCAG TAACCAATGT |
| 20001 | GGGGACCACC ACTTCTGAAA AGGAATCTTA TTCGTCTGTC CCAGCCTACT |
| 20051 | CAGAACCACC CAAAGTCACC TCTCCAATGG TTACCTCTTT CAACATAAGG |
| 20101 | GACACCATTG TTTCCACATC CATGCCTGGC TCCTCTGAGA TTACAAGGAT |
| 20151 | TGAGATGGAG TCAACATTCT CCGTGGCTCA TGGGCTGAAG GAACCAGCA |
| 20201 | CCTCCCAGGA CCCCATCGTA TCCACAGAGA AAAGTGCTGT CCTTCACAAG |
| 20251 | TTGACCACTG GTGCTACTGA GACCTCTAGG ACAGAAGTTG CCTCTTCTAG |
| 20301 | AAGAACATCC ATTCCAGGCC CTGATCATTC CACAGAGTCA CCAGACATCT |
| 20351 | CCACTGAAGT GATCCCCAGC CTGCCTATCT CCCTTGGCAT TACAGAATCT |
| 20401 | TCAAATATGA CCATCATCAC TCGAACAGGT CCTCCTCTTG GCTCTACATC |
| 20451 | ACAGGGCACA TTTACCTTGG ACACACCAAC TACATCCTCC AGGGCAGGAA |
| 20501 | CACACTCGAT GGCGACTCAG GAATTTCCAC ACTCAGAAAT GACCACTGTC |
| 20551 | ATGAACAAGG ACCCTGAGAT TCTATCATGG ACAATCCCTC CTTCTATAGA |
| 20601 | GAAACCAGC TTCTCCTCTT CCCTGATGCC TTCACCAGCC ATGACTTCAC |
| 20651 | CTCCTGTTTC CTCAACATTA CCAAAGACCA TTCACACCAC TCCTTCTCCT |
| 20701 | ATGACCTCAC TGCTCACCCC TAGCCTAGTG ATGACCACAG ACACATTGGG |
| 20751 | CACAAGCCCA GAACCTACAA CCAGTTCACC TCCAAATTTG AGCAGTACCT |
| 20801 | CACATGAGAT ACTGACAACA GATGAAGACA CCACAGCTAT AGAAGCCATG |
| 20851 | CATCCTTCCA AAGCACAGC AGCGACTAAT GTGGAAACCA CCAGTTCTGG |
| 20901 | ACATGGGTCA CAATCCTCTG TCCTAGCTGA CTCAGAAAAA ACCAAGGCCA |
| 20951 | CAGCTCCAAT GGATACCACC TCCACCATGG GGCATACAAC TGTTTCCACA |
| 21001 | TCAATGTCTG TTTCCTCTGA GACTACAAAA ATTAAGAGAG AGTCAACATA |
| 21051 | TTCCTTGACT CCTGGACTGA GAGAGACCAG CATTTCCCAA AATGCCAGCT |
| 21101 | TTTCCACTGA CACAAGTATT GTTCTTTCAG AAGTCCCCAC TGGTACTACT |
| 21151 | GCTGAGGTCT CCAGGACAGA AGTCACCTCC TCTGGTAGAA CATCCATCCC |
| 21201 | TGGCCCTTCT CAGTCCACAG TTTTGCCAGA AATATCCACA AGAACAATGA |
| 21251 | CAAGGCTCTT TGCCTCGCCC ACCATGACAG AATCAGCAGA AATGACCATC |
| 21301 | CCCACTCAAA CAGGTCCTTC TGGGTCTACC TCACAGGATA CCCTTACCTT |
| 21351 | GGACACATCC ACCACAAAGT CCCAGGCAAA GACTCATTCA ACTTTGACTC |
| 21401 | AGAGATTTCC ACACTCAGAG ATGACCACTC TCATGAGCAG AGGTCCTGGA |
| 21451 | GATATGTCAT GGCAAAGCTC TCCCTCTCTG GAAAATCCCA GCTCTCTCCC |

TABLE 24-continued

DNA Sequence of the CA125 Amino Terminal Extension
(SEQ ID NO: 309)

```
21501   TTCCCTGCTG TCTTTACCTG CCACAACCTC ACCTCCTCCC ATTTCCTCCA
21551   CATTACCAGT GACTATCTCC TCCTCTCCTC TTCCTGTGAC TTCACTTCTC
21601   ACCTCTAGCC CGGTAACGAC CACAGACATG TTACACACAA GCCCAGAACT
21651   TGTAACCAGT TCACCTCCAA AGCTGAGCCA CACTTCAGAT GAGAGACTGA
21701   CCACTGGCAA GGACACCACA AATACAGAAG CTGTGCATCC TTCCACAAAC
21751   ACAGCAGCGT CCAATGTGGA GATTCCCAGC TCTGGACATG AATCCCCTTC
21801   CTCTGCCTTA GCTGACTCAG AGACATCCAA AGCCACATCA CCAATGTTTA
21851   TTACCTCCAC CCAGGAGGAT ACAACTGTTG CCATATCAAC CCCTCACTTC
21901   TTGGAGACTA GCAGAATTCA GAAAGAGTCA ATTTCCTCCC TGAGCCCTAA
21951   ATTGAGGGAG ACAGGCAGTT CTGTGGAGAC AAGCTCAGCC ATAGAGACAA
22001   GTGCTGTCCT TTCTGAAGTG TCCGTTGGTG CTACTACTGA GATCTCCAGG
22051   ACAGAAGTCA CCTCCTCTAG CAGAACATCC ATCTCTGGTT CTGCTGAGTC
22101   CACAATGTTG CCAGAAATAT CCACCACAAG AAAAATCATT AAGTTCCCTA
22151   CTTCCCCCAT CCTGGCAGAA TCATCAGAAA TGACCATCAA GACCCAAACA
22201   AGTCCTCCTG GGTCTACATC AGAGAGTACC TTTACATTAG ACACATCAAC
22251   CACTCCCTCC TTGGTAATAA CCCATTCGAC TATGACTCAG AGATTGCCAC
22301   ACTCAGAGAT AACCACTCTT GTGAGTAGAG GTGCTGGGGA TGTGCCACGG
22351   CCCAGCTCTC TCCCTGTGGA AGAAACAAGC CCTCCATCTT CCCAGCTGTC
22401   TTTATCTGCC ATGATCTCAC CTTCTCCTGT TTCTTCCACA TTACCAGCAA
22451   GTAGCCACTC CTCTTCTGCT TCTGTGACTT CACTTCTCAC ACCAGGCCAA
22501   GTGAAGACTA CTGAGGTGTT GGACGCAAGT GCAGAACCTG AAACCAGTTC
22551   ACCTCCAAGT TTGAGCAGCA CCTCAGTTGA ATACTGGCC ACCTCTGAAG
22601   TCACCACAGA TACGGAGAAA ATTCATCCTT TCTCAAACAC GGCAGTAACC
22651   AAAGTTGGAA CTTCCAGTTC TGGACATGAA TCCCCTTCCT CTGTCCTACC
22701   TGACTCAGAG ACAACCAAAG CCACATCGGC AATGGGTACC ATCTCCATTA
22751   TGGGGGATAC AAGTGTTTCT ACATTAACTC CTGCCTTATC TAACACTAGG
22801   AAAATTCAGT CAGAGCCAGC TTCCTCACTG ACCACCAGAT TGAGGGAGAC
22851   CAGCACCTCT GAAGAGACCA GCTTAGCCAC AGAAGCAAAC ACTGTTCTTT
22901   CTAAAGTGTC CACTGGTGCT ACTACTGAGG TCTCCAGGAC AGAAGCCATC
22951   TCCTTTAGCA GAACATCCAT GTCAGGCCCT GAGCAGTCCA CAATGTCACA
23001   AGACATCTCC ATAGGAACCA TCCCCAGGAT TTCTGCCTCC TCTGTCCTGA
23051   CAGAATCTGC AAAAATGACC ATCACAACCC AAACAGGTCC TTCGGAGTCT
23101   ACACTAGAAA GTACCCTTAA TTTGAACACA GCAACCACAC CCTCTTGGGT
23151   GGAAACCCAC TCTATAGTAA TTCAGGGATT CCACACCCA GAGATGACCA
23201   CTTCCATGGG CAGAGGTCCT GGAGGTGTGT CATGGCCTAG CCCTCCCTTT
23251   GTGAAAGAAA CCAGCCCTCC ATCCTCCCCG CTGTCTTTAC CTGCCGTGAC
23301   CTCACCTCAT CCTGTTTCCA CCACATTCCT AGCACATATC CCCCCCTCTC
23351   CCCTTCCTGT GACTTCACTT CTCACCTCTG GCCCGGCGAC AACCACAGAT
```

TABLE 24-continued

DNA Sequence of the CA125 Amino Terminal Extension
(SEQ ID NO: 309)

```
23401    ATCTTGGGTA CAAGCACAGA ACCTGGAACC AGTTCATCTT CAAGTTTGAG
23451    CACCACCTCC CATGAGAGAC TGACCACTTA CAAAGACACT GCACATACAG
23501    AAGCCGTGCA TCCTTCCACA AACACAGGAG GGACCAATGT GGCAACCACC
23551    AGCTCTGGAT ATAAATCACA GTCCTCTGTC CTAGCTGACT CATCTCCAAT
23601    GTGTACCACC TCCACCATGG GGGATACAAG TGTTCTCACA TCAACTCCTG
23651    CCTTCCTTGA GACTAGGAGG ATTCAGACAG AGCTAGCTTC CTCCCTGACC
23701    CCTGGATTGA GGGAGTCCAG TGGCTCTGAA GGGACCAGCT CAGGCACCAA
23751    GATGAGCACT GTCCTCTCTA AAGTGCCCAC TGGTGCTACT ACTGAGATCT
23801    CCAAGGAAGA CGTCACCTCC ATCCCAGGTC CCGCTCAATC CACAATATCA
23851    CCAGACATCT CCACAAGAAC CGTCAGCTGG TTCTCTACAT CCCCTGTCAT
23901    GACAGAATCA GCAGAAATAA CCATGAACAC CCATACAAGT CCTTTAGGGG
23951    CCACAACACA AGGCACCAGT ACTTTGGCCA CGTCAAGCAC AACCTCTTTG
24001    ACAATGACAC ACTCAACTAT ATCTCAAGGA TTTTCACACT CACAGATGAG
24051    CACTCTTATG AGGAGGGGTC CTGAGGATGT ATCATGGATG AGCCCTCCCC
24101    TTCTGGAAAA AACTAGACCT TCCTTTTCTC TGATGTCTTC ACCAGCCACA
24151    ACTTCACCTT CTCCTGTTTC CTCCACATTA CCAGAGAGCA TCTCTTCCTC
24201    TCCTCTTCCT GTGACTTCAC TCCTCACGTC TGGCTTGGCA AAAACTACAG
24251    ATATGTTGCA CAAAAGCTCA GAACCTGTAA CCAACTCACC TGCAAATTTG
24301    AGCAGCACCT CAGTTGAAAT ACTGGCCACC TCTGAAGTCA CCACAGATAC
24351    AGAGAAAACT CATCCTTCTT CAAACAGAAC AGTGACCGAT GTGGGGACCT
24401    CCAGTTCTGG ACATGAATCC ACTTCCTTTG TCCTAGCTGA CTCACAGACA
24451    TCCAAAGTCA CATCTCCAAT GGTTATTACC TCCACCATGG AGGATACGAG
24501    TGTCTCCACA TCAACTCCTG GCTTTTTTGA GACTAGCAGA ATTCAGACAG
24551    AACCAACATC CTCCCTGACC CTTGGACTGA GAAAGACCAG CAGCTCTGAG
24601    GGGACCAGCT TAGCCACAGA GATGAGCACT GTCCTTTCTG GAGTGCCCAC
24651    TGGTGCCACT GCTGAAGTCT CCAGGACAGA AGTCACCTCC TCTAGCAGAA
25651    CTTTCTACTT CCCCCATTAT GACAGAATCA GCAGAAAGTG CCATCACTAT
25701    TGAGACAGGT TCTCCTGGGG CTACATCAGA GGGTACCCTC ACCTTGGACA
25751    CCTCAACAAC AACCTTTTGG TCAGGGACCC ACTCAACTGC ATCTCCAGGA
25801    TTTTCACACT CAGAGATGAC CACTCTTATG AGTAGAACTC CTGGAGATGT
25851    GCCATGGCCG AGCCTTCCCT CTGTGGAAGA AGCCAGCTCT GTCTCTTCCT
25901    CACTGTCTTC ACCTGCCATG ACCTCAACTT CTTTTTTCTC CACATTACCA
25951    GAGAGCATCT CCTCCTCTCC TCATCCTGTG ACTGCACTTC TCACCCTTGG
26001    CCCAGTGAAG ACCACAGACA TGTTGCGCAC AAGCTCAGAA CCTGAAACCA
26051    GTTCACCTCC AAATTTGAGC AGCACCTCAG CTGAAATATT AGCCACGTCT
26101    GAAGTCACCA AAGATAGAGA GAAAATTCAT CCCTCCTCAA ACACACCTGT
26151    AGTCAATGTA GGGACTGTGA TTTATAAACA TCTATCCCCT TCCTCTGTTT
26201    TGGCTGACTT AGTGACAACA AAACCCACAT CTCCAATGGC TACCACCTCC
26251    ACTCTGGGGA ATACAAGTGT TCCACATCA  ACTCCTGCCT TCCCAGAAAC
```

TABLE 24-continued

DNA Sequence of the CA125 Amino Terminal Extension
(SEQ ID NO: 309)

```
26301   TATGATGACA CAGCCAACTT CCTCCCTGAC TTCTGGATTA AGGGAGATCA
26351   GTACCTCTCA AGAGACCAGC TCAGCAACAG AGAGAAGTGC TTCTCTTTCT
26401   GGAATGCCCA CTGGTGCTAC TACTAAGGTC TCCAGAACAG AAGCCCTCTC
26451   CTTAGGCAGA ACATCCACCC CAGGTCCTGC TCAATCCACA ATATCACCAG
26501   AAATCTCCAC GGAAACCATC ACTAGAATTT CTACTCCCCT CACCACGACA
26551   GGATCAGCAG AAATGACCAT CACCCCCAAA ACAGGTCATT CTGGGGCATC
26601   CTCACAAGGT ACCTTTACCT TGGACACATC AAGCAGAGCC TCCTGGCCAG
26651   GAACTCACTC AGCTGCAACT CACAGATCTC CACACTCAGG GATGACCACT
26701   CCTATGAGCA GAGGTCCTGA GGATGTGTCA TGGCCAAGCC GCCCATCAGT
26751   GGAAAAAACT AGCCCTCCAT CTTCCCTGGT GTCTTTATCT GCAGTAACCT
26801   CACCTTCGCC ACTTTATTCC ACACCATCTG AGAGTAGCCA CTCATCTCCT
26851   CTCCGGGTGA CTTCTCTTTT CACCCCTGTC ATGATGAAGA CCACAGACAT
26901   GTTGGACACA AGCTTGGAAC CTGTGACCAC TTCACCTCCC AGTATGAATA
26951   TCACCTCAGA TGAGAGTCTG GCCACTTCTA AAGCCACCAT GGAGACAGAG
27001   GCAATTCAGC TTTCAGAAAA CACAGCTGTG ACTCAGATGG CACCATCAG
27051   CGCTAGACAA GAATTCTATT CCTCTTATCC AGGCCTCCCA GAGCCATCCA
27101   AAGTGACATC TCCAGTGGTC ACCTCTTCCA CCATAAAAGA CATTGTTTCT
27151   ACAACCATAC CTGCTTCCTC TGAGATAACA AGAATTGAGA TGGAGTCAAC
27201   ATCCACCCTG ACCCCCACAC CAAGGGAGAC CAGCACCTCC CAGGAGATCC
27251   ACTCAGCCAC AAAGCCAAGC ACTGTTCCTT ACAAGGCACT CACTAGTGCC
27301   ACGATTGAGG ACTCCATGAC ACAAGTCATG TCCTCTAGCA GAGGACCTAG
27351   CCCTGATCAG TCCACAATGT CACAAGACAT ATCCAGTGAA GTGATCACCA
27401   GGCTCTCTAC CTCCCCCATC AAGGCAGAAT CTACAGAAAT GACCATTACC
27451   ACCCAAACAG GTTCTCCTGG GGCTACATCA AGGGTACCC TTACCTTGGA
27501   CACTTCAACA ACTTTTATGT CAGGGACCCA CTCAACTGCA TCTCAAGGAT
27551   TTTCACACTC ACAGATGACC GCTCTTATGA GTAGAACTCC TGGAGATGTG
27601   CCATGGCTAA GCCATCCCTC TGTGGAAGAA GCCAGCTCTG CCTCTTTCTC
27651   ACTGTCTTCA CCTGTCATGA CCTCATCTTC TCCCGTTTCT TCCACATTAC
27701   CAGACAGCAT CCACTCTTCT TCGCTTCCTG TGACATCACT TCTCACCTCA
27751   GGGCTGGTGA AGACCACAGA GCTGTTGGGC ACAAGCTCAG AACCTGAAAC
27801   CAGTTCACCC CCAAATTTGA GCAGCACCTC AGCTGAAATA CTGGCCACCA
27851   CTGAAGTCAC TACAGATACA GAGAAACTGG AGATGACCAA TGTGGTAACC
27901   TCAGGTTATA CACATGAATC TCCTTCCTCT GTCCTAGCTG ACTCAGTGAC
27951   AACAAAGGCC ACATCTTCAA TGGGTATCAC CTACCCCACA GGAGATACAA
28001   ATGTTCTCAC ATCAACCCCT GCCTTCTCTG ACACCAGTAG GATTCAAACA
28051   AAGTCAAAGC TCTCACTGAC TCCTGGGTTG ATGGAGACCA GCATCTCTGA
28101   AGAGACCAGC TCTGCCACAG AAAAAGCAC TGTCCTTTCT AGTGTGCCCA
28151   CTGGTGCTAC TACTGAGGTC TCCAGGACAG AAGCCATCTC TTCTAGCAGA
```

TABLE 24-continued

DNA Sequence of the CA125 Amino Terminal Extension
(SEQ ID NO: 309)

```
28201    ACATCCATCC CAGGCCCTGC TCAATCCACA ATGTCATCAG ACACCTCCAT

28251    GGAAACCATC ACTAGAATTT CTACCCCCCT CACAAGGAAA GAATCAACAG

28301    ACATGGCCAT CACCCCCAAA ACAGGTCCTT CTGGGGCTAC CTCGCAGGGT

28351    ACCTTTACCT TGGACTCATC AAGCACAGCC TCCTGGCCAG GAACTCACTC

28401    AGCTACAACT CAGAGATTTC CACAGTCAGT GGTGACAACT CCTATGAGCA

28451    GAGGTCCTGA GGATGTGTCA TGGCCAAGCC CGCTGTCTGT GGAAAAAAAC

28501    AGCCCTCCAT CTTCCCTGGT ATCTTCATCT TCAGTAACCT CACCTTCGCC

28551    ACTTTATTCC ACACCATCTG GGAGTAGCCA CTCCTCTCCT GTCCCTGTCA

28601    CTTCTCTTTT CACCTCTATC ATGATGAAGG CCACAGACAT GTTGGATGCA

28651    AGTTTGGAAC CTGAGACCAC TTCAGCTCCC AATATGAATA TCACCTCAGA

28701    TGAGAGTCTG GCCGCTTCTA AAGCCACCAC GGAGACAGAG GCAATTCACG

28751    TTTTTGAAAA TACAGCAGCG TCCCATGTGG AAACCACCAG TGCTACAGAG

28801    GAACTCTATT CCTCTTCCCC AGGCTTCTCA GAGCCAACAA AAGTGATATC

28851    TCCAGTGGTC ACCTCTTCCT CTATAAGAGA CAACATGGTT TCCACAACAA

28901    TGCCTGGCTC CTCTGGCATT ACAAGGATTG AGATAGAGTC AATGTCATCT

28951    CTGACCCCTG GACTGAGGGA GACCAGAACC TCCCAGGACA TCACCTCATC

29001    CACAGAGACA AGCACTGTCC TTTACAAGAT GCCCTCTGGT GCCACTCCTG

29051    AGGTCTCCAG GACAGAAGTT ATGCCCTCTA GCAGAACATC CATTCCTGGC

29101    CCTGCTCAGT CCACAATGTC ACTAGACATC TCCGATGAAG TTGTCACCAG

29151    GCTGTCTACC TCTCCCATCA TGACAGAATC TGCAGAAATA ACCATCACCA

29201    CCCAAACAGG TTATTCTCTG GCTACATCCC AGGTTACCCT TCCCTTGGGC

29251    ACCTCAATGA CCTTTTTGTC AGGGACCCAC TCAACTATGT CTCAAGGACT

29301    TTCACACTCA GAGATGACCA ATCTTATGAG CAGGGGTCCT GAAAGTCTGT

29351    CATGGACGAG CCCTCGCTTT GTGGAAACAA CTAGATCTTC CTCTTCTCTG

29401    ACATCATTAC CTCTCACGAC CTCACTTTCT CCTGTGTCCT CCACATTACT

29451    AGACAGTAGC CCCTCCTCTC CTCTTCCTGT GACTTCACTT ATCCTCCCAG

29501    GCCTGGTGAA GACTACAGAA GTGTTGGATA CAAGCTCAGA GCCTAAAACC

29551    AGTTCATCTC CAAATTTGAG CAGCACCTCA GTTGAAATAC CGGCCACCTC

29601    TGAAATCATG ACAGATACAG AGAAAATTCA TCCTTCCTCA AACACAGCGG

29651    TGGCCAAAGT GAGGACCTCC AGTTCTGTTC ATGAATCTCA TTCCTCTGTC

29701    CTAGCTGACT CAGAAACAAC CATAACCATA CCTTCAATGG GTATCACCTC

29751    CGCTGTGGAC GATACCACTG TTTTCACATC AAATCCTGCC TTCTCTGAGA

29801    CTAGGAGGAT TCCGACAGAG CCAACATTCT CATTGACTCC TGGATTCAGG

29851    GAGACTAGCA CCTCTGAAGA GACCACCTCA ATGACAGAAA CAAGTGCAGT

29901    CCTTTATGGA GTGCCCACTA GTGCTACTAC TGAAGTCTCC ATGACAGAAA

29951    TCATGTCCTC TAATAGAACA CACATCCCTG ACTCTGATCA GTCCACGATG

30001    TCTCCAGACA TCATCACTGA AGTGATCACC AGGCTCTCTT CCTCATCCAT

30051    GATGTCAGAA TCAACACAAA TGACCATCAC CACCCAAAAA AGTTCTCCTG

30101    GGGCTACAGC ACAGAGTACT CTTACCTTGG CCACAACAAC AGCCCCCTTG
```

TABLE 24-continued

DNA Sequence of the CA125 Amino Terminal Extension
(SEQ ID NO: 309)

```
30151  GCAAGGACCC ACTCAACTGT TCCTCCTAGA TTTTTACACT CAGAGATGAC
30201  AACTCTTATG AGTAGGAGTC CTGAAAATCC ATCATGGAAG AGCTCTCCCT
30251  TTGTGGAAAA AACTAGCTCT TCATCTTCTC TGTTGTCCTT ACCTGTCACG
30301  ACCTCACCTT CTGTTTCTTC CACATTACCG CAGAGTATCC CTTCCTCCTC
30351  TTTTTCTGTG ACTTCACTCC TCACCCCAGG CATGGTGAAG ACTACAGACA
30401  CAAGCACAGA ACCTGGAACC AGTTTATCTC CAAATCTGAG TGGCACCTCA
30451  GTTGAAATAC TGGCTGCCTC TGAAGTCACC ACAGATACAG AGAAAATTCA
30501  TCCTTCTTCA AGCATGGCAG TGACCAATGT GGGAACCACC AGTTCTGGAC
30551  ATGAACTATA TTCCTCTGTT TCAATCCACT CGGAGCCATC CAAGGCTACA
30601  TACCCAGTGG GTACTCCCTC TTCCATGGCT GAAACCTCTA TTTCCACATC
30651  AATGCCTGCT AATTTGAGA CCACAGGATT TGAGGCTGAG CCATTTCTC
30701  ATTTGACTTC TGGATTTAGG AAGACAAACA TGTCCCTGGA CACCAGCTCA
30751  GTCACACCAA CAAATACACC TTCTTCTCCT GGGTCCACTC ACCTTTTACA
30801  GAGTTCCAAG ACTGATTTCA CCTCTTCTGC AAAAACATCA TCCCCAGACT
30851  GGCCTCCAGC CTCACAGTAT ACTGAAATTC CAGTGGACAT AATCACCCCC
30901  TTTAATGCTT CTCCATCTAT TACGGAGTCC ACTGGGATAA CCTCCTTCCC
30951  AGAATCCAGG TTTACTATGT CTGTAACAGA AAGTACTCAT CATCTGAGTA
31001  CAGATTTGCT GCCTTCAGCT GAGACTATTT CCACTGGCAC AGTGATGCCT
31051  TCTCTATCAG AGGCCATGAC TTCATTTGCC ACCACTGGAG TTCCACGAGC
31101  CATCTCAGGT TCAGGTAGTC CATTCTCTAG GACAGAGTCA GGCCCTGGGG
31151  ATGCTACTCT GTCCACCATT GCAGAGAGCC TGCCTTCATC CACTCCTGTG
31201  CCATTCTCCT CTTCAACCTT CACTACCACT GATTCTTCAA CCATCCCAGC
31251  CCTCCATGAG ATAACTTCCT CTTCAGCTAC CCCATATAGA GTGGACACCA
31301  GTCTTGGGAC AGAGAGCAGC ACTACTGAAG GACGCTTGGT TATGGTCAGT
31351  ACTTTGGACA CTTCAAGCCA ACCAGGCAGG ACATCTTCAA CACCCATTTT
31401  GGATACCAGA ATGACAGAGA GCGTTGAGCT GGGAACAGTG ACAAGTGCTT
31451  ATCAAGTTCC TTCACTCTCA ACACGGTTGA CAAGAACTGA TGGCATT
```

TABLE 25

Amino Terminal Extension of the CA125 Gene (Protein Sequence)
(SEQ ID NO: 310)

```
  1  MLKPSGLPGS SSPTRSLMTG SRSTKATPEM DSGLTGATLS PKTSTGAIVV
 51  TEHTLPFTSP DKTLASPTSS VVGRTTQSLG VMSSALPEST SRGMTHSEQR
101  TSPSLSPQVN GTPSRNYPAT SMVSGLSSPR TRTSSTEGNF TKEASTYTLT
151  VETTSGPVTE KYTVPTETST TEGDSTETPW DTRYIPVKIT SPMKTFADST
201  ASKENAPVSM TPAETTVTDS HTPGRTNPSF GTLYSSFLDL SPKGTPNSRG
251  ETSLELILST TGYPFSSPEP GSAGHSRIST SAPLSSSASV LDNKISETSI
301  FSGQSLTSPL SPGVPEARAS TMPNSAIPFS MTLSNAETSA ERVRSTISSL
```

TABLE 25-continued

Amino Terminal Extension of the CA125 Gene (Protein Sequence)
(SEQ ID NO: 310)

```
 351  GTPSISTKQT AETILTFHAF AETMDIPSTH IAKTLASEWL GSPGTLGGTS
 401  TSALTTTSPS TTLVSEETNT HHSTSGKETE GTLNTSMTPL ETSAPGEESE
 451  MTATLVPTLG FTTLDSKIRS PSQVSSSHPT RELRTTGSTS GRQSSSTAAH
 501  GSSDILRATT SSTSKASSWT SESTAQQFSE PQHTQWVETS PSMKTERPPA
 551  STSVAAPITT SVPSVVSGFT TLKTSSTKGI WLEETSADTL IGESTAGPTT
 601  HQFAVPTGIS MTGGSSTRGS QGTTHLLTRA TASSETSADL TLATNGVPVS
 651  VSPAVSKTAA GSSPPGGTKP SYTMVSSVIP ETSSLQSSAF REGTSLGLTP
 701  LNTRHPFSSP EPDSAGHTKI STSIPLLSSA SVLEDKVSAT STFSHHKATS
 751  SITTGTPEIS TKTKPSSAVL SSMTLSNAAT SPERVRNATS PLTHPSPSGE
 801  ETAGSVLTLS TSAETTDSPN IHPTGTLTSE SSESPSTLSL PSVSGVKTTF
 851  SSSTPSTHLF TSGEETEETS NPSVSQPETS VSRVRTTLAS TSVPTPVFPT
 901  MDTWPTRSAQ FSSSHLVSEL RATSSTSVTN STGSALPKIS HLTGTATMSQ
 951  TNRDTFNDSA APQSTTWPET SPRFKTGLPS ATTTVSTSAT SLSATVMVSK
1001  FTSPATSSME ATSIREPSTT ILTTETTNGP GSMAVASTNI PIGKGYITEG
1051  RLDTSHLPIG TTASSETSMD FTMAKESVSM SVSPSQSMDA AGSSTPGRTS
1101  QFVDTFSDDV YHLTSREITI PRDGTSSALT PQMTATHPPS PDPGSARSTW
1151  LGILSSSPSS PTPKVTMSST FSTQRVTTSM IMDTVETSRW NMPNLPSTTS
1201  LTPSNIPTSG AIGKSTLVPL DTPSPATSLE ASEGGLPTLS TYPESTNTPS
1251  IHLGAHASSE SPSTINLTMA SVVKPGSYTP LTFPSIETHI HVSTARMAYS
1301  SGSSPEMTAP GETNTGSTWD PTTYITTTDP KDTSSAQVST PHSVRTLRTT
1351  ENHPKTESAT PAAYSGSPKI SSSPNLTSPA TKAWTITDTT EHSTQLHYTK
1401  LAEKSSGFET QSAPGPVSVV IPTSPTIGSS TLELTSDVPG EPLVLAPSEQ
1451  TTITLPMATW LSTSLTEEMA STDLDISSPS SPMSTFAIFP PMSTPSHELS
1501  KSEADTSAIR NTDSTTLDQH LGIRSLGRTG DLTTVPITPL TTTWTSVIEH
1551  STQAQDTLSA TMSPTHVTQS LKDQTSIPAS ASPSHLTEVY PELGTQGRSS
1601  SEATTFWKPS TDTLSREIET GPTNIQSTPP MDNTTTGSSS SGVTLGIAHL
1651  PIGTSSPAET STNMALERRS STATVSMAGT MGLLVTSAPG RSISQSLGRV
1701  SSVLSESTTE GVTDSSKGSS PRLNTQGNTA LSSSLEPSYA EGSQMSTSIP
1751  LTSSPTTPDV EFIGGSTFWT KEVTTVMTSD ISKSSARTES SSATLMSTAL
1801  GSTENTGKEK LRTASMDLPS PTPSMEVTPW ISLTLSNAPN TTDSLDLSHG
1851  VHTSSAGTLA TDRSLNTGVT RASRLENGSD TSSKSLSMGN STHTSMTDTE
1901  KSEVSSSIHP RPETSAPGAE TTLTSTPGNR AISLTLPFSS IPVEEVISTG
1951  ITSGPDINSA PMTHSPITPP TIVWTSTGTI EQSTQPLHAV SSEKVSVQTQ
2001  STPYVNSVAV SASPTHENSV SSGSSTSSPY SSASLESLDS TISRRNAITS
2051  WLWDLTTSLP TTTWPSTSLS EALSSGHSGV SNPSSTTTEF PLFSAASTSA
2101  AKQRNPETET HGPQNTAAST LNTDASSVTG LSETPVGASI SSEVPLPMAI
2151  TSRSDVSGLT SESTANPSLG TASSAGTKLT RTISLPTSES LVSFRMNKDP
2201  WTVSIPLGSH PTTNTETSIP VNSAGPPGLS TVASDVIDTP SDGAESIPTV
2251  SFSPSPDTEV TTISHFPEKT THSFRTISSL THELTSRVTP IPGDWMSSAM
```

TABLE 25-continued

Amino Terminal Extension of the CA125 Gene (Protein Sequence)
(SEQ ID NO: 310)

```
2301  STKPTGASPS ITLGERRTIT SAAPTTSPIV LTASFTETST VSLDNETTVK
2351  TSDILDARKT NELPSDSSSS SDLINTSIAS STMDVTKTAS ISPTSISGMT
2401  ASSSPSLFSS DRPQVPTSTT ETNTATSPSV SSNTYSLDGG SNVGGTPSTL
2451  PPFTITHPVE TSSALLAWSR PVRTFSTMVS TDTASGENPT SSNSVVTSVP
2501  APGTWTSVGS TTDLPAMGFL KTSPAGEAHS LLASTIEPAT AFTPHLSAAV
2551  VTGSSATSEA SLLTTSESKA IHSSPQTPTT PTSGANWETS ATPESLLVVT
2601  ETSDTTLTSK ILVTDTILFS TVSTPPSKFP STGTLSGASF PTLLPDTPAI
2651  PLTATEPTSS LATSFDSTPL VTIASDSLGT VPETTLTMSE TSNGDALVLK
2701  TVSNPDRSIP GITIQGVTES PLHPSSTSPS KIVAPRNTTY EGSITVALST
2751  LPAGTTGSLV FSQSSENSET TALVDSSAGL ERASVMPLTT GSQGMASSGG
2801  IRSGSTHSTG TKTFSSLPLT MNPGEVTAMS EITTNRLTAT QSTAPKGIPV
2851  KPTSAESGLL TPVSASSSPS KAFASLTTAP PTWGIPQSTL TFEFSEVPSL
2901  DTKSASLPTP GQSLNTIPDS DASTASSSLS KSPEKNPRAR MMTSTKAISA
2951  SSFQSTGFTE TPEGSASPSM AGHEPRVPTS GTGDPRYASE SMSYPDPSKA
3001  SSAMTSTSLA SKLTTLFSTG QAARSGSSSS PISLSTEKET SFLSPTASTS
3051  RKTSLFLGPS MARQPNILVH LQTSALTLSP TSTLNMSQEE PPELTSSQTI
3101  AEEEGTTAET QTLTFTPSET PTSLLPVSSP TEPTARRKSS PETWASSISV
                                                   Contig 27
3151  PAKTSLVETT DGTLVTTIKM SSQAAQGNST QPAPAEETGT SPAGTSPGSP
3201  EMSTTLKIMS SKEPSISPEI RSTVRNSPWK TPETTVPMET TVEPVTLQST
3251  ALGSGSTSIS HLPTGTTSPT KSPTENMLAT ERVSLPSPSP EAWTNLYSGT
3301  PGGTRQSLAT MSSVSLESPT ARSITGTGQQ SSPELVSKTT GMEFSMWHGS
3351  TGGTTGDTHV SLSTSSNILE DPVTSPNSVS SLTDKSKHKT ETWVSTTAIP
3401  STVLNNKIMA AEQQTSRSVD EAYSSTSSWS DQTSGSDITL GASPDVTNTL
3451  YITSTAQTTS LVSLPSGDQG ITSLTNPSGG KTSSASSVTS PSIGLETLRA
3501  NVSAVKSDIA PTAGHLSQTS SPAEVSILDV TTAPTPGIST TITTMGTNSI
3551  STTTPNPEVG MSTMDSTPAT ERRTTSTEHP STWSSTAASD SWTVTDMTSN
3601  LKVARSPGTI STMHTTSFLA SSTELDSMST PHGRITVIGT SLVTPSSDAS
3651  AVKTETSTSE RTLSPSDTTA STPISTFSRV QRMSISVPDI LSTSWTPSST
3701  EAEDVPVSMV PTDHASTKTD PNTPLSTFLF DSLSTLDWDT GRSLSSATAT
3751  TSAPQGATTP QELTLETMIS PATSQLPFSI GHITSAVTPA AMARSSGVTF
3801  SRPDPTSKKA EQTSTQLPTT TSAHPGQVPR SAATTLDVIP HTAKTPDATF
3851  QRQGQTALTT EARATSDSWN EKEKSTPSAP WITEMMNSVS EDTIKEVTSS
3901  SSVLKDPEYA GHKLGIWDDF IPKFGKAAHM RELPLLSPPQ DKEAIHPSTN
3951  TVETTGWVTS SEHASHSTIP AHSASSKLTS PVVTTSTREQ AIVSMSTTTW
4001  PESTRARTEP NSFLTIELRD VSPYMDTSST TQTSIISSPG STAITKGHRT
4051  EITSYKRISS SFLAQSMRSS DSPSEAITRL SNFPAMTESG GMILAMQTSP
4101  PGATSISAPT LDTSATASWT GTPLATTQRF TYSEKTTLFS KGREDTSQPS
4151  PPCVEETSSS SSVVPIHATT SPSNILLTSQ GHSPSSTPPV TSVFLSETSG
```

TABLE 25-continued

Amino Terminal Extension of the CA125 Gene (Protein Sequence)
(SEQ ID NO: 310)

```
4201  LGKTTDMSRI SLEPGTSLPP NLSSTAGEAL STYEASRDTK AIHHSADTAV

4251  TNMEATSSEY SPIPGHTKPS KATSPLVTSH IMGDITSSTS VFGSSETTEI

4301  ETVSSVNQGL QERSTSQVAS SATETSTVIT HVSSGDATTH VTKTQATFSS

4351  GTSISSPHQF ITSTNTFTDV STNPSTSLIM TESSGVTITT QTGPTGAATQ

4401  GPYLLDTSTM PYLTETPLAV TPDFMQSEKT TLISKGPKDV TWTSPPSVAE

4451  TSYPSSLTPF LVTTIPPATS TLQGQHTSSP VSATSVLTSG LVKTTDMLNT

4501  SMEPVTNSPQ NLNNPSNEIL ATLAATTDIE TIHPSINKAV TNMGTASSAH

4551  VLHSTLPVSS EPSTATSPMV PASSMGDALA SISIPGSETT DIEGEPTSSL

4601  TAGRKENSTL QEMNSTTESN IILSNVSVGA ITEATKMEVP SFDATFIPTP

4651  AQSTKFPDIF SVASSRLSNS PPMTISTHMT TTQTGSSGAT SKIPLALDTS

4701  TLETSAGTPS VVTEGFAHSK ITTAMNNDVK DVSQTNPPFQ DEASSPSSQA

4751  PVLVTTLPSS VAFTPQWHST SSPVSMSSVL TSSLVKTAGK VDTSLETVTS

4801  SPQSMSNTLD DISVTSAATT DIETTHPSIN TVVTNVGTTG SAFESHSTVS

4851  AYPEPSKSHI LPMLPPPPWK TPQFPRSIPK SSKTTRTETE TTSSLTPKLR

4901  ETSISQEITS STETSTVPYK ELTGATTEVS RTDVTSSSST SFPGPDQSTV

4951  SLDISTETNT RLSTSPIMTE SAEITITTQT GPHGATSQDT FTMDPSNTTP

5001  QAGIHSAMTH GFSQLDVTTL MSRIPQDVSW TSPPSVDKTS SPSSFLSSPA

5051  MTTPSLISST LPEDKLSSPM TSLLTSGLVK ITDILRTRLE PVTSSLPNFS

5101  STSDKILATS KDSKDTKEIF PSINTEETNV KANNSGHESH SPALADSETP

5151  KATTQMVITT TVGDPAPSTS MPVHGSSETT NIKREPTYFL TPRLRETSTS

5201  QESSFPTDTS FLLSKVPTGT ITEVSSTGVI SSSKISTPDH DKSTVPPDTF

5251  TGEIPRVFTS SIKTKSAEMT ITTQASPPES ASHSTLPLDT STTLSQGGTH

5301  STVSQGFPYS EVTTLMGMGP GNVSWMTTPP VEETSSVSSL MSSPAMTSPS

5351  PVSSTSPQSI PSSPLPVTAL PTSVLVTTTD VLGTTSPESV TSSPPNLSSI

5401  THERPATYKD TAHTEAAMHH STNTAVTNVG TSGSGHKSQS SVLADSETSK

5451  ATPLMSTAST LGDTSVSTST PNISQTNQIQ TEPTASLSPR LRESSTSEKT

5501  SSTTETNTAF SYVPTGAITQ ASRTEISSSR TSISDLDRST IAPDISTGMI

5551  TRLFTSPIMT KSAEMTVTTQ TTTPGATSQG ILPWDTSTTL FQGGTHSTVS

5601  QGFPHSEITT LRSRTPGDVS WMTTPPVEET SSGFSLMSPS MTSPSPVSST

5651  SPESIPSSPL PVTALLTSVL VTTTNVLGTT SPEPVTSSPP NLSSPTQERL

5701  TTYKDTAHTE AMHASMHTNT AVANVGTSIS GHESQSSVPA DSHTSKATSP

5751  MGITFAMGDT SVYTSTPAFF ETRIQSESTS SLIPGLRDTR TSEEINTVTE

5801  TSTVLSEVPT TTTTEVSRTE VITSSRTTIS GPDHSKMSPY ISTETITRLS

5851  TFPFVTGSTE MAITNQTGPI GTISQATLTL DTSSTASWEG THSPVTQRFP

5901  HSEETTTMSR STKGVSWQSP PSVEETSSPS SPVPLPAITS HSSLYSAVSG

5951  SSPTSALPVT SLLTSGRRKT IDMLDTHSEL VTSSLPSASS FSGEILTSEA

6001  STNTETIHFS ENTAETNMGT TNSMHKLHSS VSIHSQPSGH TPPKVTGSMM

6051  EDAIVSTSTP GSPETKNVDR DSTSPLTPEL KEDSTALVMN STTESNTVFS

6101  SVSLDAATEV SRAEVTYYDP TFMPASAQST KSPDISPEAS SSHSNSPPLT
```

TABLE 25-continued

Amino Terminal Extension of the CA125 Gene (Protein Sequence)
(SEQ ID NO: 310)

```
6151  ISTHKTIATQ TGPSGVTSLG QLTLDTSTIA TSAGTPSART QDFVDSETTS

6201  VMNNDLNDVL KTSPFSAEEA NSLSSQAPLL VTTSPSPVTS TLQEHSTSSL

6251  VSVTSVPTPT LAKITDMDTN LEPVTRSPQN LRNTLATSEA TTDTHTMHPS

6301  INTAMANVGT TSSPNEFYFT VSPDSDPYKA TSAVVITSTS GDSIVSTSMP

6351  RSSAMKKIES ETTFSLIFRL RETSTSQKIG SSSDTSTVFD KAFTAATTEV
                         Contig16
6401  SRTELTSSSR TSIQGTEKPT MSPDTSTRSV TMLSTFAGLT KSEERTIATQ

6451  TGPHRATSQG TLTWDTSITT SQAGTHSAMT HGFSQLDLST LTSRVPEYIS

6501  GTSPPSVEKT SSSSSLLSLP AITSPSPVPT TLPESRPSSP VHLTSLPTSG

6551  LVKTTDMLAS VASLPPNLGS TSHKIPTTSE DIKDTEKMYP STNIAVTNVG

6601  TTTSEKESYS SVPAYSEPPK VTSPMVTSFN IRDTIVSTSM PGSSEITRIE

6651  MESTFSLAHG LKGTSTSQDP IVSTEKSAVL HKLTTGATET SRTEVASSRR

6701  TSIPGPDHST ESPDISTEVI PSLPISLGIT ESSNMTIITR TGPPLGSTSQ

6751  GTFTLDTPTT SSRAGTHSMA TQEFPHSEMT TVMNKDPEIL SWTIPPSIEK

6801  TSFSSSLMPS PAMTSPPVSS TLPKTIHTTP SPMTSLLTPS LVMTTDTLGT

6851  SPEPTTSSPP NLSSTSHEIL TTDEDTTAIE AMHPSTSTAA TNVETTSSGH

6901  GSQSSVLADS EKTKATAPMD TTSTMGHTTV STSMSVSSET TKIKRESTYS

6951  LTPGLRETSI SQNASFSTDT SIVLSEVPTG TTAEVSRTEV TSSGRTSIPG

7001  PSQSTVLPEI STRTMTRLFA SPTMTESAEM TIPTQTGPSG STSQDTLTLD

7051  TSTTKSQAKT HSTLTQRFPH SEMTTLMSRG PGDMSWQSSP SLENPSSLPS

7101  LLSLPATTSP PPISSTLPVT ISSSPLPVTS LLTSSPVTTT DMLHTSPELV

7151  TSSPPKLSHT SDERLTTGKD TTNTEAVHPS TNTAASNVEI PSSGHESPSS

7201  ALADSETSKA TSPMFITSTQ EDTTVAISTP HFLETSRIQK ESISSLSPKL
                         Contig10
7251  RETGSSVETS SAIETSAVLS EVSVGATTEI SRTEVTSSSR TSISGSAIST

7301  MLPEISTTRK IIKFPTSPIL AISSEMTIKT QTSPPGSTSE STFTLDTSTT

7351  PSLVITHSTM TQRLPHSEIT TLVSRGAGDV PRPSSLPVEE TSPPSSQLSL

7401  SAMISPSPVS STLPASSHSS SASVTSLLTP GQVKTTEVLD ASAEPETSSP

7451  PSLSSTSVEI LATSEVTTDT EKIHPFSNTA VTKVGTSSSG HESPSSVLPD

7501  SETTKATSAM GTISIMGDTS VSTLTPALSM TRKIQSEPAS SLTTRLRETS

7551  TSEETSLATE ANTVLSKVST GATTEVSRTE AISFSRTSMS GPEQSTMSQD

7601  ISIGTIPRIS ASSVLTESAK MTITTQTGPS ESTLESTLNL NTATTPSWVE

7651  THSIVIQGFP HPEMTTSMGR GPGGVSWPSP PFVKETSPPS SPLSLPAVTS
                         Contig22
7701  PHPVSTTFLA HIPPSPLPVT SLLTSGPATT TDILGTSTEP GTSSSSSLST

7751  TSHERLTTYK DTAHTEAVHP STNTGGTNVA TTSSGYKSQS SVLADSSPMC

7801  TTSTMGDTSV LTSTPAFLET RRIQTELASS LTPGLRESSG SEGTSSGTKM

7851  STVLSKVPTG ATTEISKEDV TSIPGPAQST ISPDTSTRTV SWFSTSPVMT

7901  ESAEITMNTH TSPLGATTQG TSTLDTSSTT SLTMTHSTIS QGFSHSQMST

7951  LMRRGPEDVS WMSPPLLEKT RPSFSLMSSP ATTSPSPVSS TLPESISSSP

8001  LPVTSLLTSG LAKTTDMLHK SSEPVTNSPA NLSSTSVEIL ATSEVTTDTE
```

TABLE 25-continued

Amino Terminal Extension of the CA125 Gene (Protein Sequence)
(SEQ ID NO: 310)

```
8051  KTHPSSNRTV TDVGTSSSGH ESTSFVLADS QTSKVTSPMV ITSTMEDTSV

8101  STSTPGFFET SRIQTEPTSS LTLGLRKTSS SEGTSLATEM STVLSGVPTG

8151  ATAEVSRTEV TSSSRTSISG FAQLTVSPET STETITRLPT SSIMTESAEM

8201  MIKTQTDPPG STPESTHTVD ISTTPNWVET HSTVTQRFSH SEMTTLVSRS

8251  PGDMLWPSQS SVEETSSASS LLSLPATTSP SPVSSTLVED FPSASLPVTS

8301  LLTPGLVITT DRMGISREPG TSSTSNLSST SHERLTTLED TVDTEAMQPS

8351  THTAVTNVRT SISGHESQSS VLSDSETPKA TSSMGTTYTM GETSVSISTS

8401  DFFETSRVQI EPTSSLTSGL RETSSSERIS SATEGSTVLS EVPSGATTEV

8451  SRTEVISSRG TSMSGPDQFT ISPDISTEAI TRLSTSPIMT ESAESAITIE

8501  TGSPGATSEG TLTLDTSTTT FWSGTHSTAS PGFSHSEMTT LMSRTPGDVP

8551  WPSLPSVEEA SSVSSSLSSP AMTSTSFFST LPESISSSPH PVTALLTLGP

8601  VKTTDMLRTS SEPETSSPPN LSSTSAEILA TSEVTKDREK IHPSSNTPVV

8651  NVGTVIYKHL SPSSVLADLV TTKPTSPMAT TSTLGNTSVS TSTPAFPETM

8701  MTQPTSSLTS GLREISTSQE TSSATERSAS LSGMPTGATT KVSRTEALSL

8751  GRTSTPGPAQ STISPEISTE TITRISTPLT TTGSAEMTIT PKTGHSGASS

8801  QGTFTLDTSS RASWPGTHSA ATHRSPHSGM TTPMSRGPED VSWPSRPSVE

8851  KTSPPSSLVS LSAVTSPSPL YSTPSESSHS SPLRVTSLFT PVMMKTTDML

8901  DTSLEPVTTS PPSMNITSDE SLATSKATME TEAIQLSENT AVTQMGTISA

8951  RQEFYSSYPG LPEPSKVTSP VVTSSTIKDI VSTTIPASSE ITRIEMESTS

9001  TLTPTPRETS TSQEIHSATK PSTVPYKALT SATIEDSMTQ VMSSSRGPSP

9051  DQSTMSQDIS TEVITRLSTS PIKAESTEMT ITTQTGSPGA TSRGTLTLDT

9101  STTFMSGTHS TASQGFSHSQ MTALMSRTPG DVPWLSHPSV EEASSASFSL

9151  SSPVMTSSSP VSSTLPDSIH SSSLPVTSLL TSGLVKTTEL LGTSSEPETS

9201  SPPNLSSTSA EILATTEVTT DTEKLEMTNV VTSGYTHESP SSVLADSVTT

9251  KATSSMGITY PTGDTNVLTS TPAFSDTSRI QTKSKLSLTP GLMETSISEE
                                    Contig 36
9301  TSSATEKSTV LSSVPTGATT EVSRTEAISS SRTSIPGPAQ STMSSDTSME

9351  TITRISTPLT RKESTDMAIT PKTGPSGATS QGTFTLDSSS TASWPGTHSA

9401  TTQRFPQSVV TTPMSRGPED VSWPSPLSVE KNSPPSSLVS SSSVTSPSPL

9451  YSTPSGSSHS SPVPVTSLFT SIMMKATDML DASLEPETTS APNMNITSDE

9501  SLAASKATTE TEAIHVFENT AASHVETTSA TEELYSSSPG FSEPTKVISP

9551  VVTSSSIRDN MVSTTMPGSS GITRIEIESM SSLTPGLRET RTSQDITSST

9601  ETSTVLYKMP SGATPEVSRT EVMPSSRTSI PGPAQSTMSL DISDEVVTRL

9651  STSPIMTESA EITITTQTGY SLATSQVTLP LGTSMTFLSG THSTMSQGLS

9701  HSEMTNLMSR GPESLSWTSP RFVETTRSSS SLTSLPLTTS LSPVSSTLLD

9751  SSPSSPLPVT SLILPGLVKT TEVLDTSSEP KTSSSPNLSS TSVEIPATSE

9801  IMTDTEKIHP SSNTAVAKVR TSSSVHESHS SVLADSETTI TIPSMGITSA

9851  VDDTTVFTSN PAFSETRRIP TEPTFSLTPG FRETSTSEET TSITETSAVL

9901  YGVPTSATTE VSMTEIMSSN RIHIPDSDQS TMSPDIITEV ITRLSSSSMM

9951  SESTQMTITT QKSSPGATAQ STLTWPQQQP PWQGPTQLFL LDFYTSEMTT
```

TABLE 25-continued

Amino Terminal Extension of the CA125 Gene (Protein Sequence) (SEQ ID NO: 310)

```
10001  LMSRSPENPS WKSSLFVEKT SSSSSLLSLP VTTSPSVSST LPQSIPSSSF
10051  SVTSLLTPGM VKTTDTSTEP GTSLSPNLSG TSVEILAASE VTTDTEKIHP
10101  SSSMAVTNVG TTSSGHELYS SVSIHSEPSK ATYPVGTPSS MAETSISTSM
10151  PANFETTGFE AEPFSHLTSG FRKTNMSLDT SSVTPTNTPS SPGSTHLLQS
10201  SKTDFTSSAK TSSPDWPPAS QYTEIPVDII TPFNASPSIT ESTGITSFPE
10251  SRFTMSVTES THHLSTDLLP SAETISTGTV MPSLSEAMTS FATTGVPRAI
10301  SGSGSPFSRT ESGPGDATLS TIAESLPSST PVPFSSSTFT TTDSSTIPAL
10351  HEITSSSATP YRVDTSLGTE SSTTEGRLVM VSTLDTSSQP GRTSSTPILD
10401  TRMTESVELG TVTSAYQVPS LSTRLTRTDG I
```

TABLE 26

Serine/Threonine O-Glycosylation Pattern for the CA125 Amino Terminal Extension (SEQ ID NO: 310)

```
contig62
              o      oo           o                o
    1  MLKPSGLPGS SSPTRSLMTG SRSTKATPEM DSGLTGATLS PKTSTGAIVV o            o                o      o  o
   51  TEHTLPFTSP DKTLASPTSS VVGRTTQSLG VMSSALPEST SRGMTHSEQR o o       o              oo       oo x       o
  101  TSPSLSPQVN GTPSRNYPAT SMVSGLSSPR TRTSSTEGNF TKEASTYTLT oo   o     o ooo o  oo              o
  151  VETTSGPVTE KYTVPTETST TEGDSTETPW DTRYIPVKIT SPMKTFADST o        oo    o  o  o
  201  ASKENAPVSM TPAETTVTDS HTPGRTNPSF GTLYSSFLDL SPKGTPNSRG o      o        o oo
  251  ETSLELILST TGYPFSSPEP GSAGHSRIST SAPLSSSASV LDNKISETSI o  o         o   o   o                          o  o
  301  FSGQSLTSPL SPGVPEARAS TMPNSAIPFS MTLSNAETSA ERVRSTISSL o o                                             o
  351  GTPSISTKQT AETILTFHAF AETMDIPSTH IAKTLASEWL GSPGTLGGTS oo oooo o oo  o         o          x          oo
  401  TSALTTTSPS TTLVSEETNT HHSTSGKETE GTLNTSMTPL ETSAPGEESE o                 o  o  o       o o       o oo
  451  MTATLVPTLG FTTLDSKIRS PSQVSSSHPT RELRTTGSTS GRQSSSTAAH o      ooo  oo o o      o         o   o  o  o
  501  GSSDILRATT SSTSKASSWT SESTAQQFSE PQHTQWVETS PSMKTERPPA ooo    oo                                  oo    o
  551  STSVAAPITT SVPSVVSGFT TLKTSSTKGI WLEETSADTL IGESTAGPTT oo          o                    o
  601  HQFAVPTGIS MTGGSSTRGS QGTTHLLTRA TASSETSADL TLATNGVPVS o o      oo          o o  o
  651  VSPAVSKTAA GSSPPGGTKP SYTMVSSVIP ETSSLQSSAF REGTSLGLTP o    oo              oo                        oo
  701  LNTRHPFSSP EPDSAGHTKI STSIPLLSSA SVLEDKVSAT STFSHHKATS o ooo o   oo    o                   x o    o  o o
  751  SITTGTPEIS TKTKPSSAVL SSMTLSNAAT SPERVRNATS PLTHPSPSGE o  oo       o    o   oo o oo   o     o
```

TABLE 26-continued

Serine/Threonine O-Glycosylation Pattern for the CA125
Amino Terminal Extension (SEQ ID NO: 310)

```
 801 ETAGSVLTLS TSAETTDSPN IHPTGTLTSE SSESPSTLSL PSVSGVKTTF oooo oo    o         oo      o               o  o oo  o       o
 851 SSSTPSTHLF TSGEETEETS NPSVSQPETS VSRVRTTLAS TSVPTPVFPT o o                    o  oo    ox oo o
 901 MDTWPTRSAQ FSSSHLVSEL RATSSTSVTN STGSALPKIS HLTGTATMSQ x         oo        o      o     o  ooo ooo         o
 951 TNRDTFNDSA APQSTTWPET SPRFKTGLPS ATTTVSTSAT SLSATVMVSK o  o          o    oo    oo  o              o
1001 FTSPATSSME ATSIREPSTT ILTTETTNGP GSMAVASTNI PIGKGYITEG oo                    o    o o     ooo
1051 RLDTSHLPIG TTASSETSMD FTMAKESVSM SVSPSQSMDA AGSSTPGRTS oo  o     o o   o
1101 QFVDTFSDDV YHLTSREITI PRDGTSSALT PQMTATHPPS PDPGSARSTW ooo oo   o    o ooo    o   o                       oo o
1151 LGILSSSPSS PTPKVTMSST FSTQRVTTSM IMDTVETSRW NMPNLPSTTS o   o         oo      o o o    o          o         oo  o
1201 LTPSNIPTSG AIGKSTLVPL DTPSPATSLE ASEGGLPTLS TYPESTNTPS o        oo x
1251 IHLGAHASSE SPSTINLTMA SVVKPGSYTP LTFPSIETHI HVSTARMAYS o  o        o oo     oo oo     o o     o
1301 SGSSPEMTAP GETNTGSTWD PTTYITTTDP KDTSSAQVST PHSVRTLRTT o o o     o o     o  x      o  o
1351 ENHPKTESAT PAAYSGSPKI SSSPNLTSPA TKAWTITDTT EHSTQLHYTK o         o       o o o
1401 LAEKSSGFET QSAPGPVSVV IPTSPTIGSS TLELTSDVPG EPLVLAPSEQ o           oo o    oo         oo    o
1451 TTITLPMATW LSTSLTEEMA STDLDISSPS SPMSTFAIFP PMSTPSHELS o  o
1501 KSEADTSAIR NTDSTTLDQH LGIRSLGRTG DLTTVPITPL TTTWTSVIEH o   o  o oo       oo      o  o
1551 STQAQDTLSA TMSPTHVTQS LKDQTSIPAS ASPSHLTEVY PELGTQGRSS o                   o  oo     x oo  o
1601 SEATTFWKPS TDTLSREIET GPTNIQSTPP MDNTTTGSSS SGVTLGIAHL o           o                     o
1651 PIGTSSPAET STNMALERRS STATVSMAGT MGLLVTSAPG RSISQSLGRV o     o  o            o                 oo
1701 SSVLSESTTE GVTDSSKGSS PRLNTQGNTA LSSSLEPSYA EGSQMSTSIP ooo oo                     o  o   o    o
1751 LTSSPTTPDV EFIGGSTFWT KEVTTVMTSD ISKSSARTES SSATLMSTAL o ooo    o     o x
1801 GSTENTGKEK LRTASMDLPS PTPSMEVTPW ISLTLSNAPN TTDSLDLSHG o              x           x o
1851 VHTSSAGTLA TDRSLNTGVT RASRLENGSD TSSKSLSMGN STHTSMTDTE o oo         oo      o oo                        o
1901 KSEVSSSIHP RPETSAPGAE TTLTSTPGNR AISLTLPFSS IPVEEVISTG o     o o o     o    o     oo         o
1951 ITSGPDINSA PMTHSPITPP TIVWTSTGTI EQSTQPLHAV SSEKVSVQTQ o   o         o oo    oo o    oo
2001 STPYVNSVAV SASPTHENSV SSGSSTSSPY SSASLESLDS TISRRNAITS oo    ooo    o o o     o   o    o ooooo
2051 WLWDLTTSLP TTTWPSTSLS EALSSGHSGV SNPSTTTEF PLFSAASTSA
```

TABLE 26-continued

Serine/Threonine O-Glycosylation Pattern for the CA125 Amino Terminal Extension (SEQ ID NO: 310)

```
              o         o         o         o        oo
2101 AKQRNPETET HGPQNTAAST LNTDASSVTG LSETPVGASI SSEVPLPMAI oo   o                      o        o
2151 TSRSDVSGLT SESTANPSLG TASSAGTKLT RTISLPTSES LVSFRMNKDP o        o         o         o  o        o
2201 WTVSIPLGSH PTTNTETSIP VNSAGPPGLS TVASDVIDTP SDGAESIPTV o o o o  oo o          o          o  o       oo
2251 SFSPSPDTEV TTISHFPEKT THSFRTISSL THELTSRVTP IPGDWMSSAM oo  o       o    o o o  o o o    o         o        x
2301 STKPTGASPS ITLGERRTIT SAAPTTSPIV LTASFTETST VSLDNETTVK x         o   o o       o   o  o
2351 TSDILDARKT NELPSDSSSS SDLINTSIAS STMDVTKTAS ISPTSISGMT ooo   oo    o oo  o o oo o              o oo
2401 ASSSPSLFSS DRPQVPTSTT ETNTATSPSV SSNTYSLDGG SNVGGTPSTL o                    o        o o       o o      oo
2451 PPFTITHPVE TSSALLAWSR PVRTFSTMVS TDTASGENPT SSNSVVTSVP o
2501 APGTWTSVGS TTDLPAMGFL KTSPAGEAHS LLASTIEPAT AFTPHLSAAV o   o         o        oo  o oo  oo                o
2551 VTGSSATSEA SLLTTSESKA IHSSPQTPTT PTSGANWETS ATPESLLVVT o oo  o     o        o        o
2601 ETSDTTLTSK ILVTDTILFS TVSTPPSKFP STGTLSGASF PTLLPDTPAI o o o  o       o   o o       o
2651 PLTATEPTSS LATSFDSTPL VTIASDSLGT VPETTLTMSE TSNGDALVLK o       ooo  o      x          o   o
2701 TVSNPDRSIP GITIQGVTES PLHPSSTSPS KIVAPRNTTY EGSITVALST o
2751 LPAGTTGSLV FSQSSENSET TALVDSSAGL ERASVMPLTT GSQGMASSGG o          o         o         o     o o
2801 IRSGSTHSTG TKTFSSLPLT MNPGEVTAMS EITTNRLTAT QSTAPKGIPV o o o o   oo      o                o
2851 KPTSAESGLL TPVSASSSPS KAFASLTTAP PTWGIPQSTL TFEFSEVPSL o o o        o o  o
2901 DTKSASLPTP GQSLNTIPDS DASTASSSLS KSPEKNPRAR MMTSTKAISA o   o      o   o
2951 SSFQSTGFTE TPEGSASPSM AGHEPRVPTS GTGDPRYASE SMSYPDPSKA ooo                        oo                 o o
3001 SSAMTSTSLA SKLTTLFSTG QAARSGSSSS PISLSTEKET SFLSPTASTS o        oo  x       o   o
3051 RKTSLFLGPS MARQPNILVH LQTSALTLSP TSTLNMSQEE PPELTSSQTI o o o o o  oo      oo  o o              oo
3101 AEEEGTTAET QTLTFTPSET PTSLLPVSSP TEPTARRKSS PETWASSISV o         o       xoo         o o o   oo    o
3151 PAKTSLVETT DGTLVTTIKM SSQAAQGNST QPAPAEETGT SPAGTSPGSP o o              o          oo         o
3201 EMSTTLKIMS SKEPSISPEI RSTVRNSPWK TPETTVPMET TVEPVTLQST oo  o    o oo  o  o o       o       o o
3251 ALGSGSTSIS HLPTGTTSPT KSPTENMLAT ERVSLSPSPP EAWTNLYSGT o         o
3301 PGGTRQSLAT MSSVSLESPT ARSITGTGQQ SSPELVSKTT GMEFSMWHGS o                                 o o
3351 TGGTTGDTHV SLSTSSNILE DPVTSPNSVS SLTDKSKHKT ETWVSTTAIP
```

TABLE 26-continued

Serine/Threonine O-Glycosylation Pattern for the CA125
Amino Terminal Extension (SEQ ID NO: 310)

```
                o                              o  o
3401  STVLNNKIMA AEQQTSRSVD EAYSSTSSWS DQTSGSDITL GASPDVTNTL o   o                              o   o  o
3451  YITSTAQTTS LVSLPSGDQG ITSLTNPSGG KTSSASSVTS PSIGLETLRA x                  o    o               oo  o    oo o  o  o o
3501  NVSAVKSDIA PTAGHLSQTS SPAEVSILDV TTAPTPGIST TITTMGTNSI oooo       oo  oo  o       oooo      oo oo       o
3551  STTTPNPEVG MSTMDSTPAT ERRTTSTEHP STWSSTAASD SWTVTDMTSN o  oo      o   o                o  o
3601  LKVARSPGTI STMHTTSFLA SSTELDSMST PHGRITVIGT SLVTPSSDAS o   o    o o o oo  oo  o              ooo o  ooo
3651  AVKTETSTSE RTLSPSDTTA STPISTFSRV QRMSISVPDI LSTSWTPSST o              o                              o o
3701  EAEDVPVSMV PTDHASTKTD PNTPLSTFLF DSLSTLDWDT GRSLSSATAT oo     oo                         o   o
3751  TSAPQGATTP QELTLETMIS PATSQLPFSI GHITSAVTPA AMARSSGVTF o   oo     ooo    oo oo                     o
3801  SRPDPTSKKA EQTSTQLPTT TSAHPGQVPR SAATTLDVIP HTAKTPDATF o                  oo                       o
3851  QRQGQTALTT EARATSDSWN EKEKSTPSAP WITEMMNSVS EDTIKEVTSS oo
3901  SSVLKDPEYA GHKLGIWDDF IPKFGKAAHM RELPLLSPPQ DKEAIHPSTN o  o       oo    o  o         o               o
3951  TVETTGWVTS SEHASHSTIP AHSASSKLTS PVVTTSTREQ AIVSMSTTTW o                        o  o  oo
4001  PESTRARTEP NSFLTIELRD VSPYMDTSST TQTSIISSPG STAITKGHRT o                              oo
4051  EITSYKRISS SFLAQSMRSS DSPSEAITRL SNFPAMTESG GMILAMQTSP oo  o  o    oooo        o                    o
4101  PGATSISAPT LDTSATASWT GTPLATTQRF TYSEKTTLFS KGREDTSQPS ooo oo     oo          o    o ooo       o   o
4151  PPCVEETSSS SSVVPIHATT SPSNILLTSQ GHSPSSTPPV TSVFLSETSG o     x  o
4201  LGKTTDMSRI SLEPGTSLPP NLSSTAGEAL STYEASRDTK AIHHSADTAV ooo   o       o   o               o        o
4251  TNMEATSSEY SPIPGHTKPS KATSPLVTSH IMGDITSSTS VFGSSETTEI o  o           o    o         o o
4301  ETVSSVNQGL QERSTSQVAS SATETSTVIT HVSSGDATTH VTKTQATFSS oo o                  oo  o o   o oo  o oo  o o  o
4351  GTSISSPHQF ITSTNTFTDV STNPSTSLIM TESSGVTITT QTGPTGAATQ ooo    o                       o               o
4401  GPYLLDTSTM PYLTETPLAV TPDFMQSEKT TLISKGPKDV TWTSPPSVAE oo  o       oo  oo       ooo     o                  x
4451  TSYPSSLTPF LVTTIPPATS TLQGQHTSSP VSATSVLTSG LVKTTDMLNT o                         o     o
4501  SMEPVTNSPQ NLNNPSNEIL ATLAATTDIE TIHPSINKAV TNMGTASSAH oo    oo oo    oo                        o
4551  VLHSTLPVSS EPSTATSPMV PASSMGDALA SISIPGSETT DIEGEPTSSL x         x         x                        o
4601  TAGRKENSTL QEMNSTTESN IILSNVSGVA ITEATKMEVP SFDATFIPTP o            o        o oo    oo o  o    o        o
```

TABLE 26-continued

Serine/Threonine O-Glycosylation Pattern for the CA125
Amino Terminal Extension (SEQ ID NO: 310)

```
4651 AQSTKFPDIF SVASSRLSNS PPMTISTHMT TTQTGSSGAT SKIPLALDTS o   o    o                     o          oo o
4701 TLETSAGTPS VVTEGFAHSK ITTAMNNDVK DVSQTNPPFQ DEASSPSSQA o             oo oo     o                         o
4751 PVLVTTLPSS VAFTPQWHST SSPVSMSSVL TSSLVKTAGK VDTSLETVTS o    o   oo           o            oo o
4801 SPQSMSNTLD DISVTSAATT DIETTHPSIN TVVTNVGTTG SAFESHSTVS o   o   o    oooo  o
4851 AYPEPSKSHI LPMLPPPPWK TPQFPRSIPK SSKTTRTETE TTSSLTPKLR oo oo  oo                  oooooo  o        o
4901 ETSISQEITS STETSTVPYK ELTGATTEVS RTDVTSSSST SFPGPDQSTV o     oo   o       oo       o        o    o  o
4951 SLDISTETNT RLSTSPIMTE SAEITITTQT GPHGATSQDT FTMDPSNTTP o      oo o  o  oo
5001 QAGIHSAMTH GFSQLDVTTL MSRIPQDVSW TSPPSVDKTS SPSSFLSSPA oo  o    o                              o   x  o
5051 MTTPSLISST LPEDKLSSPM TSLLTSGLVK ITDILRTRLE PVTSSLPNFS x                 o  o
5101 STSDKILATS KDSKDTKEIF PSINTEETNV KANNSGHESH SPALADSETP o    oo  o    ooo      oo                  ooo
5151 KATTQMVITT TVGDPAPSTS MPVHGSSETT NIKREPTYFL TPRLRETSTS o  o     o       oo               oo
5201 QESSFPTDTS FLLSKVPTGT ITEVSSTGVI SSSKISTPDH DKSTVPPDTF o        oo  o    o  oo    o  o
5251 TGEIPRVFTS SIKTKSAEMT ITTQASPPES ASHSTLPLDT STTLSQGGTH o            x     oo       oo oo   oo   oo o
5301 STVSQGFPYS EVTTLMGMGP GNVSWMTTPP VEETSSVSSL MSSPAMTSPS oooo o    oo    o    o    o     ooo     ooo  x oo
5351 PVSSTSPQSI PSSPLPVTAL PTSVLVTTTD VLGTTSPESV TSSPPNLSSI o                                                o
5401 THERPATYKD TAHTEAAMHH STNTAVTNVG TSGSGHKSQS SVLADSETSK o  o    oo oooo   x   o      o  o         ooo  o
5451 ATPLMSTAST LGDTSVSTST PNISQTNQIQ TEPTASLSPR LRESSTSEKT oooo     o    o         o         oo         o
5501 SSTTETNTAF SYVPTGAITQ ASRTEISSSR TSISDLDRST IAPDISTGMI o  o    oo  ooo   o
5551 TRLFTSPIMT KSAEMTVTTQ TTTPGATSQG ILPWDTSTTL FQGGTHSTVS oo        oo  o  o o   o o  ooo
5601 QGFPHSEITT LRSRTPGDVS WMTTPPVEET SSGFSLMSPS MTSPSPVSST o  o  oo                oo o    ooo    x oo
5651 SPESIPSSPL PVTALLTSVL VTTTNVLGTT SPEPVTSSPP NLSSPTQERL o         oo  o
5701 TTYKDTAHTE AMHASMHTNT AVANVGTSIS GHESQSSVPA DSHTSKATSP o               o                     o
5751 MGITFAMGDT SVYTSTPAFF ETRIQSESTS SLIPGLRDTR TSEEINTVTE oo  o   o oo     o       o  o         o            o
5801 TSTVLSEVPT TTTTEVSRTE VITSSRTTIS GPDHSKMSPY ISTETITRLS ox       o         o o o         o
5851 TFPFVTGSTE MAITNQTGPI GTISQATLTL DTSSTASWEG THSPVTQRFP o             ooo o o       o          o
5901 HSEETTTMSR STKGVSWQSP PSVEETSSPS SPVPLPAITS HSSLYSAVSG
```

TABLE 26-continued

Serine/Threonine O-Glycosylation Pattern for the CA125 Amino Terminal Extension (SEQ ID NO: 310)

```
         oo oo                              o
5951  SSPTSALPVT SLLTSGRRKT IDMLDTHSEL VTSSLPSASS FSGEILTSEA o                o
6001  STNTETIHFS ENTAETNMGT TNSMHKLHSS VSIHSQPSGH TPPKVTGSMM oooo                              x   oo
6051  EDAIVSTSTP GSPETKNVDR DSTSPLTPEL KEDSTALVMN STTESNTVFS o                 oo       o    o oo o o
6101  SVSLDAATEV SRAEVTYYDP TFMPASAQST KSPDISPEAS SSHSNSPPLT o  o          o     oo  o    o
6151  ISTHKTIATQ TGPSGVTSLG QLTLDTSTIA TSAGTPSART QDFVDSETTS o   ooo o  oo     ooo
6201  VMNNDLNDVL KTSPFSAEEA NSLSSQAPLL VTTSPSPVTS TLQEHSTSSL o oo  o o         o          o       oo   o
6251  VSVTSVPTPT LAKITDMDTN LEPVTRSPQN LRNTLATSEA TTDTHTMHPS o                     ooo         oo
6301  INTAMANVGT TSSPNEFYFT VSPDSDPYKA TSAVVITSTS GDSIVSTSMP o
6351  RSSAMKKIES ETTFSLIFRL RETSTSQKIG SSSDTSTVFD KAFTAATTEV oo  o   o    o     oo
6401  SRTELTSSSR TSIQGTEKPT MSPDTSTRSV TMLSTFAGLT KSEERTIATQ o        oo  oo                     o      o
6451  TGPHRATSQG TLTWDTSITT SQAGTHSAMT HGFSQLDLST LTSRVPEYIS oo        ooo   o    oo  o   o o   o oo     o  o
6501  GTSPPSVEKT SSSSSLLSLP AITSPSPVPT TLPESRPSSP VHLTSLPTSG o   o
6551  LVKTTDMLAS VASLPPNLGS TSHKIPTTSE DIKDTEKMYP STNIAVTNVG o         o         o       oo
6601  TTTSEKESYS SVPAYSEPPK VTSPMVTSFN IRDTIVSTSM PGSSEITRIE o   o
6651  MESTFSLAHG LKGTSTSQDP IVSTEKSAVL HKLTTGATET SRTEVASSRR oo        oo       oo            x         o     o
6701  TSIPGPDHST ESPDISTEVI PSLPISLGIT ESSNMTIITR TGPPLGSTSQ o oo oo         o                              o
6751  GTFTLDTPTT SSRAGTHSMA TQEFPHSEMT TVMNKDPEIL SWTIPPSIEK o ooo   o    oo    oo o   o oo   o oo
6801  TSFSSSLMPS PAMTSPPVSS TLPKTIHTTP SPMTSLLTPS LVMTTDTLGT o  oooo   x ooo        o        o oo   o   ooo
6851  SPEPTTSSPP NLSSTSHEIL TTDEDTTAIE AMHPSTSTAA TNVETTSSGH ooo    oo  ooo   o
6901  GSQSSVLADS EKTKATAPMD TTSTMGHTTV STSMSVSSET TKIKRESTYS o       x          o                o    o  o
6951  LTPGLRETSI SQNASFSTDT SIVLSEVPTG TTAEVSRTEV TSSGRTSIPG oo        oo         o o       o o
7001  PSQSTVLPEI STRTMTRLFA SPTMTESAEM TIPTQTGPSG STSQDTLTLD o oo                        o                o
7051  TSTTKSQAKT HSTLTQRFPH SEMTTLMSRG PGDMSWQSSP SLENPSSLPS o   ooo     ooo   o ooo    oo    oo  o
7101  LLSLPATTSP PPISSTLPVT ISSSPLPVTS LLTSSPVTTT DMLHTSPELV ooo                  o     o             o      o
7151  TSSPPKLSHT SDERLTTGKD TTNTEAVHPS TNTAASNVEI PSSGHESPSS o   o       o        o     o
7201  ALADSETSKA TSPMFITSTQ EDTTVAISTP HFLETSRIQK ESISSLSPKL
```

TABLE 26-continued

Serine/Threonine O-Glycosylation Pattern for the CA125
Amino Terminal Extension (SEQ ID NO: 310)

```
                  o                  o  o o     oo o  o  oo
7251  RETGSSVETS SAIETSAVLS EVSVGATTEI SRTEVTSSSR TSISGSAIST o                  o   o  o   ooo  oo      ooo
7301  MLPEISTTRK IIKFPTSPIL AISSEMTIKT QTSPPGSTSE STFTLDTSTT o     o                                 oo      o
7351  PSLVITHSTM TQRLPHSEIT TLVSRGAGDV PRPSSLPVEE TSPPSSQLSL o  oo  oo    o   oooo  o              o    ooo
7401  SAMISPSPVS STLPASSHSS SASVTSLLTP GQVKTTEVLD ASAEPETSSP o ooo o    o   o                oo         oo
7451  PSLSSTSVEI LATSEVTTDT EKIHPFSNTA VTKVGTSSSG HESPSSVLPD o            oo  oo                          o
7501  SETTKATSAM GTISIMGDTS VSTLTPALSM TRKIQSEPAS SLTTRLRETS oo   o  o          o
7551  TSEETSLATE ANTVLSKVST GATTEVSRTE AISFSRTSMS GPEQSTMSQD o          o       oo  o   o  o       oo
7601  ISIGTIPRIS ASSVLTESAK MTITTQTGPS ESTLESTLNL NTATTPSWVE o              oo   o  o      oo
7651  THSIVIQGFP HPEMTTSMGR GPGGVSWPSP PFVKETSPPS SPLSLPAVTS o           o      o oo   o         oo     oooooo oo
7701  PHPVSTTFLA HIPPSPLPVT SLLTSGPATT TDILGTSTEP GTSSSSSLST o         o       oo
7751  TSHERLTTYK DTAHTEAVHP STNTGGTNVA TTSSGYKSQS SVLADSSPMC o o   oo    o o                              o    o
7801  TTSTMGDTSV LTSTPAFLET RRIQTELASS LTPGLRESSG SEGTSSGTKM o     o  o     o       oo      oo       oo  o    o    o
7851  STVLSKVPTG ATTEISKEDV TSIPGPAQST ISPDTSTRTV SWFSTSPVMT o      o    ooooo o     o
7901  ESAEITMNTH TSPLGATTQG TSTLDTSSTT SLTMTHSTIS QGFSHSQMST o o  oo    ooo o  oo        o o
7951  LMRRGPEDVS WMSPPLLEKT RPSFSLMSSP ATTSPSPVSS TLPESISSSP o    o o    x   o       oo   o
8001  LPVTSLLTSG LAKTTDMLHK SSEPVTNSPA NLSSTSVEIL ATSEVTTDTE o   x       oo              o    o       oo    oo
8051  KTHPSSNRTV TDVGTSSSGH ESTSFVLADS QTSKVTSPMV ITSTMEDTSV oooo          o              o      o     oo  o
8101  STSTPGFFET SRIQTEPTSS LTLGLRKTSS SEGTSLATEM STVLSGVPTG o    o  o  o        o      o   o  oo  o
8151  ATAEVSRTEV TSSSRTSISG FAQLTVSPET STETITRLPT SSIMTESAEM o     oo  oo     ooo            o
8201  MIKTQTDPPG STPESTHTVD ISTTPNWVET HSTVTQRFSH SEMTTLVSRS o oo    o   ooo   o   o
8251  PGDMLWPSQS SVEETSSASS LLSLPATTSP SPVSSTLVED FPSASLPVTS o     ooo x  o                 o    o
8301  LLTPGLVITT DRMGISREPG TSSTSNLSST SHERLTTLED TVDTEAMQPS o         o        o o      o  oo
8351  THTAVTNVRT SISGHESQSS VLSDSETPKA TSSMGTTYTM GETSVSISTS o                  o        o       o
8401  DFFETSRVQI EPTSSLTSGL RETSSSERIS SATEGSTVLS EVPSGATTEV o    o  o      o      o  o  o         o
8451  SRTEVISSRG TSMSGPDQFT ISPDISTEAI TRLSTSPIMT ESAESAITIE o o           oo  o         oo  o                  o o
```

TABLE 26-continued

Serine/Threonine O-Glycosylation Pattern for the CA125
Amino Terminal Extension (SEQ ID NO: 310)

```
8501 TGSPGATSEG TLTLDTSTTT FWSGTHSTAS PGFSHSEMTT LMSRTPGDVP o o o oo    ooo     o        o o
8551 WPSLPSVEEA SSVSSSLSSP AMTSTSFFST LPESISSSPH PVTALLTLGP oo o   ooo  x   ooo         o
8601 VKTTDMLRTS SEPETSSPPN LSSTSAEILA TSEVTKDREK IHPSSNTPVV o   o  o oo   xoo o  ooo
8651 NVGTVIYKHL SPSSVLADLV TTKPTSPMAT TSTLGNTSVS TSTPAFPETM o  oo  o     oo    o   o  oo o     o
8701 MTQPTSSLTS GLREISTSQE TSSATERSAS LSGMPTGATT KVSRTEALSL ooo       oo o   o    o oo    oo o   o o      o
8751 GRTSTPGPAQ STISPEISTE TITRISTPLT TTGSAEMTIT PKTGHSGASS o           o             o
8801 QGTFTLDTSS RASWPGTHSA ATHRSPHSGM TTPMSRGPED VSWPSRPSVE oo    o   o  oo o   oo  o  o
8851 KTSPPSSLVS LSAVTSPSPL YSTPSESSHS SPLRVTSLFT PVMMKTTDML o    ooo   x  o      o  o
8901 DTSLEPVTTS PPSMNITSDE SLATSKATME TEAIQLSENT AVTQMGTISA o    o    o o     ooo     o
8951 RQEFYSSYPG LPEPSKVTSP VVTSSTIKDI VSTTIPASSE ITRIEMESTS o o o  oo oo   o o  oo                    oo
9001 TLTPTPRETS TSQEIHSATK PSTVPYKALT SATIEDSMTQ VMSSSRGPSP oo      o      o       o       oo  o o    o
9051 DQSTMSQDIS TEVITRLSTS PIKAESTEMT ITTQTGSPGA TSRGTLTLDT o         o                                o
9101 STTFMSGTHS TASQGFSHSQ MTALMSRTPG DVPWLSHPSV EEASSASFSL oo    ooo   ooo        o                  oo    oo
9151 SSPVMTSSSP VSSTLPDSIH SSSLPVTSLL TSGLVKTTEL LGTSSEPETS o  x oooo       oo  o                 o        o
9201 SPPNLSSTSA EILATTEVTT DTEKLEMTNV VTSGYTHESP SSVLADSVTT o o         o  o                         o o
9251 KATSSMGITY PTGDTNVLTS TPAFSDTSRI QTKSKLSLTP GLMETSISEE oo  o  oo   oo  o  oo    o   oo    oo       oo  o
9301 TSSATEKSTV LSSVPTGATT EVSRTEAISS SRTSIPGPAQ STMSSDTSME o          o o             o    o o   o
9351  TITRISTPLT RKESTDMAIT PKTGPS-
GATS QGTFTLDSSS TASWPGTHSA o           o   o                   o  o ooo oo  o
9401 TTQRFPQSVV TTPMSRGPED VSWPSPLSVE KNSPPSSLVS SSSVTSPSPL oo o oo o o                              oo      x
9451 YSTPSGSSHS SPVPVTSLFT SIMMKATDML DASLEPETTS APNMNITSDE o                          o   o   ooo     o
9501 SLAASKATTE TEAIHVFENT AASHVETTSA TEELYSSSPG FSEPTKVISP o  o       oo     o          o                 o oo
9551 VVTSSSIRDN MVSTTMPGSS GITRIEIESM SSLTPGLRET RTSQDITSST o          o      o     o oo       o
9601 ETSTVLYKMP SGATPEVSRT EVMPSSRTSI PGPAQSTMSL DISDEVVTRL o               o                    o
9651 STSPIMTESA EITITTQTGY SLATSQVTLP LGTSMTFLSG THSTMSQGLS o   o oo    o o    o
9701 HSEMTNLMSR GPESLSWTSP RFVETTRSSS SLTSLPTTS LSPVSSTLLD o o     o                oo      ooo x oo oo     oo
9751 SSPSSPLPVT SLILPGLVKT TEVLDTSSEP KTSSSPNLSS TSVEIPATSE
```

TABLE 26-continued

Serine/Threonine O-Glycosylation Pattern for the CA125
Amino Terminal Extension (SEQ ID NO: 310)

```
                          o        o                     o    oo
9801   IMTDTEKIHP SSNTAVAKVR TSSSVHESHS SVLADSETTI TIPSMGITSA o          o                    ooo   o o
9851   VDDTTVFTSN PAFSETRRIP TEPTFSLTPG FRETSTSEET TSITETSAVL oo oo                          o o       o
9901   YGVPTSATTE VSMTEIMSSN RIHIPDSDQS TMSPDIITEV ITRLSSSSMM o oo     o    oo    o   o
9951   SESTQMTITT QKSSPGATAQ STLTWPQQQP PWQGPTQLFL LDFYTSEMTT o  o    ooo o ooo        oo
10001  LMSRSPENPS WKSSLFVEKT SSSSSLLSLP VTTSPSVSST LPQSIPSSSF o             oo    o o x                 o
10051  SVTSLLTPGM VKTTDTSTEP GTSLSPNLSG TSVEILAASE VTTDTEKIHP o                o    o o      o ooo
10101  SSSMAVTNVG TTSSGHELYS SVSIHSEPSK ATYPVGTPSS MAETSISTSM x    o oo o o o o    o      o
10151  PANFETTGFE AEPFSHLTSG FRKTNMSLDT SSVTPTNTPS SPGSTHLLQS o o   o o     o  o                   o o     o
10201  SKTDFTSSAK TSSPDWPPAS QYTEIPVDII TPFNASPSIT ESTGITSFPE o o  o          o o o o    o o           oo
10251  SRFTMSVTES THHLSTDLLP SAETISTGTV MPSLSEAMTS FATTGVPRAI o        o       o o     ooo      oooo o oo ooo
10301  SGSGSPFSRT ESGPGDATLS TIAESLPSST PVPFSSSTFT TDSSTIPAL oooo       o o                      o      ooo
10351  HEITSSSATP YRVDTSLGTE SSTTEGRLVM VSTLDTSSQP GRTSSTPILD o              o
10401  TRMTESVELG TVTSAYQVPS LSTRLTRTDG I
```

TABLE 27

Genomic CA125 Amino Terminal Sequence
(SEQ ID NO: 311)

```
  1  GGTGCGCACC ACTATGTCTG GCTAATTTTT GTATTTTTTT GTAGAGACAT
 51  GGTTTCACCA TGTTGGCCAG GCTGGTCTCG AATTCCTGAC TTCAAGTAAT
101  CCACCCACCT CAGCCTCCCA AAGTGCTGGG ATTACAAGCA TGAGCCACCA
151  TGCATGGCCT AAAGCTTCTT TTAAAGCCAC CAAGTCCCTT CCCATGTTAG
201  CCCACTAATC CATGGGTTAG TCATGAATGG ATTAATCTAT TCATACGGAC
251  AGAGCCCTCA TCACCCAATC ACCTCTTAAA GGCCCCACCT CTCAATACTG
301  CCACACTGGG GATTAAGTTT CAACAGAGTT TTGGAGGGGA CATTCAAATC
351  ATAGTAATGC CCAAAGTGAA AAATCTTCCC TGCACTTTTC CCTCAACAAA
401  AACAGCCAGA GATAGTGAGC TGCCAGGAAA TTCTTTTTTT TTTCCTCTTC
451  TGTCCTAAAT CAGCATCGCT AGACCTTTAC ATGATTCAAC CTCATCTTCT
501  TCACCCTCTG GGTCATGAAA TTTTATTTAT TTATTTATTA TTTTCTTGGG
551  ACAGACTCTG GCTCTGTCGC CCAGGCTGAA GTGCAGTGGT GTGATCTTGG
601  CTCACTGCAA CCTCCGCCTC CCGGGTTCAA GCGATTCTCC TGCCTCAGCC
651  TCCTGAGTAG CTGGGATTAC AGGTGGGCGC CACCACACCC AGCTAATTTT
701  TTGTATTTTT AGTAGAGATG GGGTTTCACC ATATTAGCCA GGATGGTCTC
```

TABLE 27-continued

Genomic CA125 Amino Terminal Sequence
(SEQ ID NO: 311)

```
 751  CATCTCTTGA CCTCGTGATC TGCCCACCTC AGCCTCCCAA AATGCTGGGA
 801  TTACAGGCAT GAGACACCAC GCCCAGCAGG CCAGGGTCAT GAGATTTTAA
 851  TCAAGAGCAA CTTCCACTGA TTCCTGAGAG TGCATCTGTG GGCCCCTGCT
 901  CTGATCTGAA CAGAAGTGCC GTGTCTTCTC TGACCTCCAC TTCTCAATTC
 951  AAGAGCCTTA GTATCTGCCA GTATCACACA CTGAGCATTA GCTCCATCTC
1001  ATGGGGGTGT AGGTAGGGGC TCTATCTGCA TCTTTCTTTC TTTTTTTCTT
1051  TCTTTCCCTT CCTCCCTTCC TCACTCCCTC GGTCCTCTCT TTCTTTCCTT
1101  TTCTTTCTTC CTTCCTCCCT TCCTCCCTCC CTCCCTCTCT CTTTCTCTCT
1151  TTCTTTCTTT CCTTCTTTCT TTCTTTCTCT CTTCCTTCCC TCCCTCCCTC
1201  CTTCCTTCCT TTCTCTTTCT TTCTCTTTCT TTCTTTTTTT CCTTCCTTCC
1251  TTCCTTCTTT CTCTTTCTCT CCCTCCCTTC CTTCCTTCCT TCCTTCCTTC
1301  CTTCCTTTCT TTCTTTCTTT CTTTCTTTCT TTCTTTCTTT CTTTCTTTCT
1351  TTCTTTCTTC CTTCCTTCCT TCCTTCCTTC CTTCCTTCCT TCCTTCCTTT
1401  CTTTTCTTTC TTTCTCTTTC TTTTTGAGAC AGAGCTCTTA TTACCCATGC
1451  TGGAGTGCAG TGGTGTGACC TTGGCTTACT GCAACATCTG CCTCCTAGGG
1501  TCAAGTGATT CTCCTGCCTC AGCCTCCTAA GTAGCTGGGA TTACAGACAC
1551  ATGCCACCAC ACCCAATATT TATTTTTATT AAAATTTTTT TTAAAATTAT
1601  TTTTAAAAAA TTAAAAATAA TTTTGTATTT TTAGTAGAGA CGGGGTTTCT
1651  CCATGTTGGT CAGGCTGATC TCAAACTCCC AACCTCAGGT GATCCTCCCA
1701  CCTCACCTCC CAAAGTGCTG GGATTACAGG CATGAGCCAC CGTGCCCAGC
1751  CTGGTTCCTG GTTTCTAAGA CATCACACAC ACACACACAC ACACACACAC
1801  ACACTCACAC ACTCAGAGAG AGAGAGAGAG AGAGGATCAT TAAGACATGA
1851  TACACTAAGA AATTCTATTC TGCAGACACT GAGAATCCGT TAAAAAGTTT
1901  GAAGGGAAGA ATTGAGATCA TCAGGTGTTT ATTTGAGGAA ATTGTCTGTG
1951  GTTGAACTAT CCTTTCCTTT CTCTCCCTGA GATTTGGTCT TCTCAATTAG
2001  AAGCGTTGCA CAATTCCCCC AACCTCCATA CATACGGCAG CTCTTCTAGA
2051  CACAGGTTTT CCCAGGTCAA ATGCGGGGAC CCCAGCCATA TCTCCCACCC
2101  TGAGAAATTT TGGAGTTTCA GGGAGCTCAG AAGCTCTGCA GAGGCCACCC
2151  TCTCTGAGGG GATTCTTCTT AGACCTCCAT CCAGAGGCAA ATGTTGACCT
Exon1
2201  GTCCATGCTG AAACCCTCAG GCCTTCCTGG GTCATCTTCT CCCACCCGCT
2251  CCTTGATGAC AGGGAGCAGG AGCACTAAAG CCACACCAGA AATGGATTCA
2301  GGACTGACAG GAGCCACCTT GTCACCTAAG ACATCTACAG GTGCAATCGT
2351  GGTGACAGAA CATACTCTGC CCTTTACTTC CCCAGATAAG ACCTTGGCCA
2401  GTCCTACATC TTCGGTTGTG GGAAGAACCA CCCAGTCTTT GGGGGTGATG
2451  TCCTCTGCTC TCCCTGAGTC AACCTCTAGA GGAATGACAC ACTCCGAGCA
2501  AAGAACCAGC CCATCGCTGA GTCCCCAGGT CAATGGAACT CCCTCTAGGA
2551  ACTACCCTGC TACAAGCATG GTTTCAGGAT TGAGTTCCCC AAGGACCAGG
2601  ACCAGTTCCA CAGAAGGAAA TTTTACCAAA GAAGCATCTA CATACACACT
```

TABLE 27-continued

Genomic CA125 Amino Terminal Sequence
(SEQ ID NO: 311)

```
2651  CACTGTAGAG ACCACAAGTG GCCCAGTCAC TGAGAAGTAC ACAGTCCCCA

2701  CTGAGACCTC AACAACTGAA GGTGACAGCA CAGAGACCCC CTGGGACACA

2751  AGATATATTC CTGTAAAAAT CACATCTCCA ATGAAAACAT TTGCAGATTC

2801  AACTGCATCC AAGGAAAATG CCCCAGTGTC TATGACTCCA GCTGAGACCA

2851  CAGTTACTGA CTCACATACT CCAGGAAGGA CAAACCCATC ATTTGGGACA

2901  CTTTATTCTT CCTTCCTTGA CCTATCACCT AAAGGGACCC CAAATTCCAG

2951  AGGTGAAACA AGCCTGGAAC TGATTCTATC AACCACTGGA TATCCCTTCT

3001  CCTCTCCTGA ACCTGGCTCT GCAGGACACA GCAGAATAAG TACCAGTGCG

3051  CCTTTGTCAT CATCTGCTTC AGTTCTCGAT AATAAAATAT CAGAGACCAG

3101  CATATTCTCA GGCCAGAGTC TCACCTCCCC TCTGTCTCCT GGGGTGCCCG

3151  AGGCCAGAGC CAGCACAATG CCCAACTCAG CTATCCCTTT TTCCATGACA

3201  CTAAGCAATG CAGAAACAAG TGCCGAAAGG GTCAGAAGCA CAATTTCCTC

3251  TCTGGGGACT CCATCAATAT CCACAAAGCA GACAGCAGAG ACTATCCTTA

3301  CCTTCCATGC CTTCGCTGAG ACCATGGATA TACCCAGCAC CCACATAGCC

3351  AAGACTTTGG CTTCAGAATG GTTGGGAAGT CCAGGTACCC TTGGTGGCAC

3401  CAGCACTTCA GCGCTGACAA CCACATCTCC ATCTACCACT TTAGTCTCAG

3451  AGGAGACCAA CACCCATCAC TCCACGAGTG GAAAGGAAAC AGAAGGAACT

3501  TTGAATACAT CTATGACTCC ACTTGAGACC TCTGCTCCTG GAGAAGAGTC

3551  CGAAATGACT GCCACCTTGG TCCCCACTCT AGGTTTTACA ACTCTTGACA

3601  GCAAGATCAG AAGTCCATCT CAGGTCTCTT CATCCCACCC AACAAGAGAG

3651  CTCAGAACCA CAGGCAGCAC CTCTGGGAGG CAGAGTTCCA GCACAGCTGC

3701  CCACGGGAGC TCTGACATCC TGAGGGCAAC CACTTCCAGC ACCTCAAAAG

3751  CATCATCATG GACCAGTGAA AGCACAGCTC AGCAATTTAG TGAACCCCAG

3801  CACACACAGT GGGTGGAGAC AAGTCCTAGC ATGAAAACAG AGAGACCCCC

3851  AGCATCAACC AGTGTGGCAG CCCCTATCAC CACTTCTGTT CCCTCAGTGG

3901  TCTCTGGCTT CACCACCCTG AAGACCAGCT CCACAAAAGG GATTTGGCTT

3951  GAAGAAACAT CTGCAGACAC ACTCATCGGA GAATCCACAG CTGGCCCAAC

4001  CACCCATCAG TTTGCTGTTC CCACTGGGAT TTCAATGACA GGAGGCAGCA

4051  GCACCAGGGG AAGCCAGGGC ACAACCCACC TACTCACCAG AGCCACAGCA

4101  TCATCTGAGA CATCCGCAGA TTTGACTCTG CCACGAACG GTGTCCCAGT

4151  CTCCGTGTCT CCAGCAGTGA GCAAGACGGC TGCTGGCTCA AGTCCTCCAG

4201  GAGGGACAAA GCCATCATAT ACAATGGTTT CTTCTGTCAT CCCTGAGACA

4251  TCATCTCTAC AGTCCTCAGC TTTCAGGGAA GGAACCAGCC TGGGACTGAC

4301  TCCATTAAAC ACTAGACATC CCTTCTCTTC CCCTGAACCA GACTCTGCAG

4351  GACACACCAA GATAAGCACC AGCATTCCTC TGTTGTCATC TGCTTCAGTT

4401  CTTGAGGATA AAGTGTCAGC GACCAGCACA TTCTCACACC ACAAAGCCAC

4451  CTCATCTATT ACCACAGGGA CTCCTGAAAT CTCAACAAAG ACAAAGCCCA

4501  GCTCAGCCGT TCTTTCCTCC ATGACCCTAA GCAATGCAGC AACAAGTCCT
```

TABLE 27-continued

| Genomic CA125 Amino Terminal Sequence (SEQ ID NO: 311) | |
|---|---|
| 4551 | GAAAGAGTCA GAAATGCAAC TTCCCTCTG ACTCATCCAT CTCCATCAGG |
| 4601 | GGAAGAGACA GCAGGGAGTG TCCTCACTCT CAGCACCTCT GCTGAGACTA |
| 4651 | CAGACTCACC TAACATCCAC CCAACTGGGA CACTGACTTC AGAATCGTCA |
| 4701 | GAGAGTCCTA GCACTCTCAG CCTCCCAAGT GTCTCTGGAG TCAAAACCAC |
| 4751 | ATTTTCTTCA TCTACTCCTT CCACTCATCT ATTTACTAGT GGAGAAGAAA |
| 4801 | CAGAGGAAAC TTCGAATCCA TCTGTGTCTC AACCTGAGAC TTCTGTTTCC |
| 4851 | AGAGTAAGGA CCACCTTGGC CAGCACCTCT GTCCCTACCC CAGTATTCCC |
| 4901 | CACCATGGAC ACCTGGCCTA CACGTTCAGC TCAGTTCTCT TCATCCCACC |
| 4951 | TAGTGAGTGA GCTCAGAGCT ACGAGCAGTA CCTCAGTTAC AAACTCAACT |
| 5001 | GGTTCAGCTC TTCCTAAAAT ATCTCACCTC ACTGGGACGG CAACAATGTC |
| 5051 | ACAGACCAAT AGAGACACGT TAATGACTC TGCTGCACCC CAAAGCACAA |
| 5101 | CTTGGCCAGA GACTAGTCCC AGATTCAAGA CAGGGTTACC TTCAGCAACA |
| 5151 | ACCACTGTTT CAACCTCTGC CACTTCTCTC TCTGCTACTG TAATGGTCTC |
| 5201 | TAAATTCACT TCTCCAGCAA CTAGTTCCAT GGAAGCAACT TCTATCAGGG |
| 5251 | AACCATCAAC AACCATCCTC ACAACAGAGA CCACGAATGG CCCAGGCTCT |
| 5301 | ATGGCTGTGG CTTCTACCAA CATCCCAATT GGAAAGGGCT ACATTACTGA |
| 5351 | AGGAAGATTG GACACAAGCC ATCTGCCCAT GGAACCACA GCTTCCTCTG |
| 5401 | AGACATCTAT GGATTTTACC ATGGCCAAAG AAAGTGTCTC AATGTCAGTA |
| 5451 | TCTCCATCTC AGTCCATGGA TGCTGCTGGC TCAAGCACTC CAGGAAGGAC |
| 5501 | AAGCCAATTC GTTGACACAT TTTCTGATGA TGTCTATCAT TTAACATCCA |
| 5551 | GAGAAATTAC AATACCTAGA GATGGAACAA GCTCAGCTCT GACTCCACAA |
| 5601 | ATGACTGCAA CTCACCCTCC ATCTCCTGAT CCTGGCTCTG CTAGAAGCAC |
| 5651 | CTGGCTTGGC ATCTTGTCCT CATCTCCTTC TTCTCCTACT CCCAAAGTCA |
| 5701 | CAATGAGCTC CACATTTTCA ACTCAGAGAG TCACCACAAG CATGATAATG |
| 5751 | GACACAGTTG AAACTAGTCG GTGGAACATG CCCAACTTAC CTTCCACGAC |
| 5801 | TTCCTTGACA CCAAGTAATA TTCCAACAAG TGGTGCCATA GGAAAAAGCA |
| 5851 | CCCTGGTTCC CTTGGACACT CCATCTCCAG CCACATCATT GGAGGCATCA |
| 5901 | GAAGGGGAC TTCCAACCCT CAGCACCTAC CCTGAATCAA CAAACACACC |
| 5951 | CAGCATCCAC CTCGGAGCAC ACGCTAGTTC AGAAAGTCCA AGCACCATCA |
| 6001 | AACTTACCAT GGCTTCAGTA GTAAAACCTG GCTCTTACAC ACCTCTCACC |
| 6051 | TTCCCCTCAA TAGAGACCCA CATTCATGTA TCAACAGCCA GAATGGCTTA |
| 6101 | CTCTTCTGGG TCTTCACCTG AGATGACAGC TCCTGGAGAG ACTAACACTG |
| 6151 | GTAGTACCTG GGACCCCACC ACCTACATCA CCACTACGGA TCCTAAGGAT |
| 6201 | ACAAGTTCAG CTCAGGTCTC TACACCCCAC TCAGTGAGGA CACTCAGAAC |
| 6251 | CACAGAAAAC CATCCAAAGA CAGAGTCCGC CACCCCAGCT GCTTACTCTG |
| 6301 | GAAGTCCTAA AATCTCAAGT TCACCCAATC TCACCAGTCC GGCCACAAAA |
| 6351 | GCATGGACCA TCACAGACAC AACTGAACAC TCCACTCAAT TACATTACAC |
| 6401 | AAAATTGGCA GAAAAATCAT CTGGATTTGA GACACAGTCA GCTCCAGGAC |
| 6451 | CTGTCTCTGT AGTAATCCCT ACCTCCCCTA CCATTGGAAG CAGCACATTG |

TABLE 27-continued

Genomic CA125 Amino Terminal Sequence
(SEQ ID NO: 311)

```
6501  GAACTAACTT CTGATGTCCC AGGGGAACCC CTGGTCCTTG CTCCCAGTGA
6551  GCAGACCACA ATCACTCTCC CCATGGCAAC ATGGCTGAGT ACCAGTTTGA
6601  CAGAGGAAAT GGCTTCAACA GACCTTGATA TTTCAAGTCC AAGTTCACCC
6651  ATGAGTACAT TTGCTATTTT TCCACCTATG TCCACACCTT CTCATGAACT
6701  TTCAAAGTCA GAGGCAGATA CCAGTGCCAT TAGAAATACA GATTCAACAA
6751  CGTTGGATCA GCACCTAGGA ATCAGGAGTT TGGGCAGAAC TGGGGACTTA
6801  ACAACTGTTC CTATCACCCC ACTGACAACC ACGTGGACCA GTGTGATTGA
6851  ACACTCAACA CAAGCACAGG ACACCCTTTC TGCAACGATG AGTCCTACTC
6901  ACGTGACACA GTCACTCAAA GATCAAACAT CTATACCAGC CTCAGCATCC
6951  CCTTCCCATC TTACTGAAGT CTACCCTGAG CTCGGGACAC AAGGGAGAAG
7001  CTCCTCTGAG GCAACCACTT TTTGGAAACC ATCTACAGAC ACACTGTCCA
7051  GAGAGATTGA GACTGGCCCA ACAAACATTC AATCCACTCC ACCCATGGAC
7101  AACACAACAA CAGGGAGCAG TAGTAGTGGA GTCACCCTGG GCATAGCCCA
7151  CCTTCCCATA GGAACATCCT CCCCAGCTGA GACATCCACA AACATGGCAC
7201  TGGAAAGAAG AAGTTCTACA GCCACTGTCT CTATGGCTGG GACAATGGGA
7251  CTCCTTGTTA CTAGTGCTCC AGGAAGAAGC ATCAGCCAGT CATTAGGAAG
7301  AGTTTCCTCT GTCCTTTCTG AGTCAACTAC TGAAGGAGTC ACAGATTCTA
7351  GTAAGGGAAG CAGCCCAAGG CTGAACACAC AGGGAAATAC AGCTCTCTCC
7401  TCCTCTCTTG AACCCAGCTA TGCTGAAGGA AGCCAGATGA GCACAAGCAT
7451  CCCTCTAACC TCATCTCCTA CAACTCCTGA TGTGGAATTC ATAGGGGGCA
7501  GCACATTTTG GACCAAGGAG GTCACCACAG TTATGACCTC AGACATCTCC
7551  AAGTCTTCAG CAAGGACAGA GTCCAGCTCA GCTACCCTTA TGTCCACAGC
7601  TTTGGGAAGC ACTGAAAATA CAGGAAAAGA AAAACTCAGA ACTGCCTCTA
7651  TGGATCTTCC ATCTCCAACT CCATCAATGG AGGTGACACC ATGGATTTCT
7701  CTCACTCTCA GTAATGCCCC CAATACCACA GATTCACTTG ACCTCAGCCA
7751  TGGGGTGCAC ACCAGCTCTG CAGGGACTTT GGCCACTGAC AGGTCATTGA
7801  ATACTGGTGT CACTAGAGCC TCCAGATTGG AAAACGGCTC TGATACCTCT
7851  TCTAAGTCCC TGTCTATGGG AAACAGCACT CACACTTCCA TGACTTACAC
7901  AGAGAAGAGT GAAGTGTCTT CTTCAATCCA TCCCCGACCT GAGACCTCAG
7951  CTCCTGGAGC AGAGACCACT TTGACTTCCA CTCCTGGAAA CAGGGCCATA
8001  AGCTTAACAT TGCCTTTTTC ATCCATTCCA GTGGAAGAAG TCATTTCTAC
8051  AGGCATAACC TCAGGACCAG ACATCAACTC AGCACCCATG ACACATTCTC
8101  CCATCACCCC ACCAACAATT GTATGGACCA GTACAGGCAC AATTGAACAG
8151  TCCACTCAAC CACTACATGC AGTTTCTTCA GAAAAAGTTT CTGTGCAGAC
8201  ACAGTCAACT CCATATGTCA ACTCTGTGGC AGTGTCTGCT TCCCCTACCC
8251  ATGAGAATTC AGTCTCTTCT GGAAGCAGCA CATCCTCTCC ATATTCCTCA
8301  GCCTCACTTG AATCCTTGGA TTCACAATC AGTAGGAGGA ATGCAATCAC
8351  TTCCTGGCTA TGGGACCTCA CTACATCTCT CCCCACTACA ACTTGGCCAA
```

TABLE 27-continued

Genomic CA125 Amino Terminal Sequence
(SEQ ID NO: 311)

```
 8401 GTACTAGTTT ATCTGAGGCA CTGTCCTCAG GCCATTCTGG GGTTTCAAAC
 8451 CCAAGTTCAA CTACGACTGA ATTTCCACTC TTTTCAGCTG CATCCACATC
 8501 TGCTGCTAAG CAAAGAAATC CAGAAACAGA GACCCATGGT CCCCAGAATA
 8551 CAGCCGCGAG TACTTTGAAC ACTGATGCAT CCTCGGTCAC AGGTCTTTCT
 8601 GAGACTCCTG TGGGGCAAG TATCAGCTCT GAAGTCCCTC TTCCAATGGC
 8651 CATAACTTCT AGATCAGATG TTTCTGGCCT TACATCTGAG AGTACTGCTA
 8701 ACCCGAGTTT AGGCACAGCC TCTTCAGCAG GGACCAAATT AACTAGGACA
 8751 ATATCCCTGC CCACTTCAGA GTCTTTGGTT TCCTTTAGAA TGAACAAGGA
 8801 TCCATGGACA GTGTCAATCC CTTTGGGGTC CCATCCAACT ACTAATACAG
 8851 AAACAAGCAT CCCAGTAAAC AGCGCAGGTC CACCTGGCTT GTCCACAGTA
 8901 GCATCAGATG TAATTGACAC ACCTTCAGAT GGGGCTGAGA GTATTCCCAC
 8951 TGTCTCCTTT TCCCCCTCCC CTGATACTGA AGTGACAACT ATCTCACATT
 9001 TCCCAGAAAA GACAACTCAT TCATTTAGAA CCATTTCATC TCTCACTCAT
 9051 GAGTTGACTT CAAGAGTGAC ACCTATTCCT GGGGATTGGA TGAGTTCAGC
 9101 TATGTCTACA AAGCCCACAG GAGCCAGTCC CTCCATTACA CTGGGAGAGA
 9151 GAAGGACAAT CACCTCTGCT GCTCCAACCA CTTCCCCCAT AGTTCTCACT
 9201 GCTAGTTTCA CAGAGACCAG CACAGTTTCA CTGGATAATG AAACTACAGT
 9251 AAAAACCTCA GATATCCTTG ACGCACGGAA AACAAATGAG CTCCCCTCAG
 9301 ATAGCAGTTC TTCTTCTGAT CTGATCAACA CCTCCATAGC TTCTTCAACT
 9351 ATGGATGTCA CTAAAACAGC CTCCATCAGT CCCACTAGCA TCTCAGGAAT
 9401 GACAGCAAGT TCCTCCCCAT CTCTCTTCTC TTCAGATAGA CCCCAGGTTC
 9451 CCACATCTAC AACAGAGACA AATACAGCCA CCTCTCCATC TGTTTCCAGT
 9501 AACACCTATT CTCTTGATGG GGGCTCCAAT GTGGGTGGCA CTCCATCCAC
 9551 TTTACCACCC TTTACAATCA CCCACCCTGT CGAGACAAGC TCGGCCCTAT
 9601 TAGCCTGGTC TAGACCAGTA AGAACTTTCA GCACCATGGT CAGCACTGAC
 9651 ACTGCCTCCG GAGAAAATCC TACCTCTAGC AATTCTGTGG TGACTTCTGT
 9701 TCCAGCACCA GGTACATGGA CCAGTGTAGG CAGTACTACT GACTTACCTG
 9751 CCATGGGCTT TCTCAAGACA AGTCCTGCAG GAGAGGCACA CTCACTTCTA
 9801 GCATCAACTA TTGAACCAGC CACTGCCTTC ACTCCCCATC TCTCAGCAGC
 9851 AGTGGTCACT GGATCCAGTG CTACATCAGA AGCCAGTCTT CTCACTACGA
 9901 GTGAAAGCAA AGCCATTCAT TCTTCACCAC AGACCCCAAC TACACCCACC
 9951 TCTGGAGCAA ACTGGGAAAC TTCAGCTACT CCTGAGAGCC TTTTGGTAGT
10001 CACTGAGACT TCAGACACAA CACTTACCTC AAAGATTTTG GTCACAGATA
10051 CCATCTTGTT TTCAACTGTG TCCACGCCAC CTTCTAAATT TCCAAGTACG
10101 GGGACTCTGT CTGGAGCTTC CTTCCCTACT TTACTCCCGG ACACTCCAGC
10151 CATCCCTCTC ACTGCCACTG AGCCAACAAG TTCATTAGCT ACATCCTTTG
10201 ATTCCACCCC ACTGGTGACT ATAGCTTCGG ATAGTCTTGG CACAGTCCCA
10251 GAGACTACCC TGACCATGTC AGAGACCTCA AATGGTGATG CACTGGTTCT
10301 TAAGACAGTA AGTAACCCAG ATAGGAGCAT CCCTGGAATC ACTATCCAAG
```

TABLE 27-continued

Genomic CA125 Amino Terminal Sequence
(SEQ ID NO: 311)

```
10351  GAGTAACAGA AAGTCCACTC CATCCTTCTT CCACTTCCCC CTCTAAGATT
10401  GTTGCTCCAC GGAATACAAC CTATGAAGGT TCGATCACAG TGGCACTTTC
10451  TACTTTGCCT GCGGGAACTA CTGGTTCCCT TGTATTCAGT CAGAGTTCTG
10501  AAAACTCAGA GACAACGGCT TTGGTAGACT CATCAGCTGG GCTTGAGAGG
10551  GCATCTGTGA TGCCACTAAC CACAGGAAGC CAGGGTATGG CTAGCTCTGG
10601  AGGAATCAGA AGTGGGTCCA CTCACTCAAC TGGAACCAAA ACATTTTCTT
10651  CTCTCCCTCT GACCATGAAC CCAGGTGAGG TTACAGCCAT GTCTGAAATC
10701  ACCACGAACA GACTGACAGC TACTCAATCA ACAGCACCCA AAGGGATACC
10751  TGTGAAGCCC ACCAGTGCTG AGTCAGGCCT CCTAACACCT GTCTCTGCCT
10801  CCTCAAGCCC ATCAAAGGCC TTTGCCTCAC TGACTACAGC TCCCCCAACT
10851  TGGGGATCC CACAGTCTAC CTTGACATTT GAGTTTTCTG AGGTCCCAAG
10901  TTTGGATACT AAGTCCGCTT CTTTACCAAC TCCTGGACAG TCCCTGAACA
10951  CCATTCCAGA CTCAGATGCA AGCACAGCAT CTTCCTCACT GTCCAAGTCT
11001  CCAGAAAAAA ACCCAAGGGC AAGGATGATG ACTTCCACAA AGGCCATAAG
11051  TGCAAGCTCA TTTCAATCAA CAGGTTTTAC TGAAACCCCT GAGGGATCTG
11101  CCTCCCCTTC TATGGCAGGG CATGAACCCA GAGTCCCCAC TTCAGGAACA
11151  GGGGACCCTA GATATGCCTC AGAGAGCATG TCTTATCCAG ACCCAAGCAA
11201  GGCATCATCA GCTATGACAT CGACCTCTCT TGCATCAAAA CTCACAACTC
11251  TCTTCAGCAC AGGTCAAGCA GCAAGGTCTG GTTCTAGTTC CTCTCCCATA
11301  AGCCTATCCA CTGAGAAAGA AACAAGCTTC CTTTCCCCCA CTGCATCCAC
11351  CTCCAGAAAG ACTTCACTAT TTCTTGGGCC TTCCATGGCA AGGCAGCCCA
11401  ACATATTGGT GCATCTTCAG ACTTCAGCTC TGACACTTTC TCCAACATCC
11451  ACTCTAAATA TGTCCCAGGA GGAGCCTCCT GAGTTAACCT CAAGCCAGAC
11501  CATTGCAGAA GAAGAGGGAA CAACAGCTGA ACACAGACG TTAACCTTCA
11551  CACCATCTGA GACCCCAACA TCCTTGTTAC CTGTCTCTTC TCCCACAGAA
11601  CCCACAGCCA GAAGAAAGAG TTCTCCAGAA ACATGGGCAA GCTCTATTTC
11651  AGTTCCTGCC AAGACCTCCT TGGTTGAAAG TAAGAATGCC CTGCTCCTTC
11701  CCCAAGTGTG CTGGGGATGA ATCTGGAAAT AAACTACATC TTTTTTATTT
11751  TTTAAACTTT TATATTTGAA AATATAAATA TTTTAGGTTC AGGGAACATG
11801  TGCAGGTTTG TTATATAGGT AAATTGCATG TCATGGGGGC TTGGGGTACA
11851  GATTACATCA TCAGCCAGGT AATAAGCCTA GTACCTGATC AGTAGATTTT
11901  TTTTAATCCT CTCCCTCCTC CCAGCCTCCA CCCTCAATTC ACATGTCTCC
11951  ATGTGTACTC AAGGTTTAAT TCCCACTTAT GAGTGAGAAC ATGCGGTATT
12001  TGTAAACTAC ATCTTTATTT TTGCTAACCT CGAACTGAAA TTTAGCATTT
12051  GTTTTATTGA TGAATAGAGG TAACAAAACA AACCCACATTA ATCCTAGCAG
12101  TGCCTGTGCC TTTGCCAACA ACAGAAATTC CGGACACTTT CATATCCTAT
12151  GACAATTGTT GCAAGCACTT TTAAAAATCA TGTACGACTT TATTCATAAT
12201  TATAGTGGTT ATTAGGCTTT TCAATAGATC TTATTTAATG AGTTAGTAAA
```

TABLE 27-continued

Genomic CA125 Amino Terminal Sequence
(SEQ ID NO: 311)

```
12251  ATAAGTGCCT GTATTATTGT ATTACATTTG TTTATTAAGA TCTTGATAAC

12301  AACATTTCAA TATAATCATT TCCTTTGTTT TTTAAATTTT AGATTCAGGG

12351  GTATATGTGC AGGTTTGTTA CGTGGATATA CTGCATAATG ATGAGGTTTG

12401  GCTTCTAGTG AACCCATCAG CCAAATAGTG AATGTTGTGC CAATAAGTA

12451  GTTTTTCAAT CCTCACTTCA CTCCCAGCCT CCTCTATTTT GGAGTCCCAG

12501  TGTCTATTAT TTCTATCTTT ATGTCCACAT GTACCCATTG GTTAGCTCCC

12551  ACTATAAGT GAGAATGTGC AGTATTTAAT TTTCTGTTTT TGAGTTATTT

12601  TGCTTAGGTT GATGGCCTTC AGCTCCAGCC ACGTTGCTTT AAAGAACATG

12651  ATTTCATTCT TTTTTATGGC TGCATAGTAC TCCGAGGTGT ATGTGTACCA

12701  GATTTTCTTT ATCCACAATG ATTCCTTTG TAATCTAATA TTTTATATTG

12751  TTATTTTATG TTTTATTCTA TATTTTTATT TTAATTTATA AAGGAATTCA

12801  TATGGTTCAC AAGCCTGTCA AAGGGACCTA TAATAAAAAG AGGTTAAGAA

12851  TCCATGCTCT AAACAGAATA TTACTCCATT TTATTTCATT TATTTTTAAA

12901  GAGACAGTCT CACTCTGTCA TCCAGGCTGG AGTACAGTGG AGTGATCATA

12951  GCTCATTGCA ACCCTGAACT CTTGGGCACA AGCAATTCTC CTGCTTCATC

13001  CTCCAGAGGA GCTGGGACTA CAGGTGCACA TCACCATGCC CAGCTAGTTT

13051  TAAAAATTAT TTTGTAGAGA TGGTGTCTCA CTATCCTACC CAGGCTGGTC

13101  TCAAACTCCT GGGCTCAGGC AATCCTCCCA CTTTGACCTC CCAAAGTGTT

13151  GAGATTACAG GGCAAGCCA CTGTGCCTGG CCACTTGTCA CATTTTAATT

13201  TGTGATTACT TATAAAATGA ACCCCTTCCC ATCTGAGATC TGTCAGTCTT

13251  TCTGGTGACG GTGCCTGGTG TCTGCTTTCT ACCATGTCCT GTTAGACTAG

13301  TGTTTGATGG GAGGTCACCT GGGCAGCTGT CCAGCTCACT CACTGGGCTC

13351  TAGAGCCTCT GAGTTGAAGC AAAATAGAAA GATCAGTCAA TGTAAAGAAA

13401  GCTCAAAAAC TGACATTCTG AAGTAATGGA TAGCTAAACC TTCCTATTGC
Exon 2
13451  CCTTTTCTTT CAGCAACTGA TGGAACGCTA GTGACCACCA TAAAGATGTC

13501  AAGCCAGGCA GCACAAGGAA ATTCCACGTG GCCTGCCCCA GCAGAGGAGA

13551  CGGGGACCAG TCCAGCAGGT AAATATAGAC CTTGTTTCCA TTTCTGCTCT

13601  GCTAATGCCA CCCAAGCCTT TCTTTTCTTT TCTTTTCTTT TCTTTTCTTT

13651  TCTTTTCTTT TCTTTTCTTT CTCTCCCTTT CTTTCTTTCT TTCTTTCTTT

13701  CTTTCTTTCT TTCTTTCTTT CTTTCTTTCT CTTTCTTTCT TTCTTTCTTT

13751  CTTTCTTTCT TTCTTTCTTT CTTTCTTTCT CTTTCTTTCT TCTTTCTCTC

13801  TCTCTCTTTC TTTCTTTCTC TTGTTCTTTT TAAATTTTTT ATTTTTTTAC

13851  TTAATTTTTT TCACCCAAGC CTTAAGGCCA GTTTGGACCA GATAGTGAGA

13901  CCCCACCTCT ATAAAAAAAA TTTTTAAAAA AAAAATAAGT TGGGCATCGT

13951  GCAGGCCTGT AGTCCCTGCT ACTCGAGAGG CCAAGGTGGG AGGACAGCTT

14001  GCTGCTGACT AAAAGTGCTG CTTATTGATT CTGGGAAGAA AAAATATACA

14051  AGGCTTCAGT TTCATTATTT TATAAGTAAA TGCTAGCAAC TTTTCCTTTC

14101  TTTCTCTCTT TCTCTCTTCC TCTCTTTCTC TCCTCTCCTT CTCTTCTCTC
```

TABLE 27-continued

Genomic CA125 Amino Terminal Sequence
(SEQ ID NO: 311)

```
14151 TCTCTCTCTC TCTCTCTCTC TTTCTCTCTC CTCTCCTTCT CTTCTCTTCT

14201 TTCTCTCTCT CTCTCTTTCA TTTATTTTTG AGACATGGTC TCATTCTGTC

14251 ACCCAGGCTG GAGTACAGTG GTGTATATTT ACTGCAGTAC TCACTGTACT

14301 CACTGCAGCC TCAAATTCCT GGGCTCAAGC TATCCTCTCA CCTCAGCCTC

14351 CTGAGTAGCT GGGCAGCAGT CCAGCTCACT CACTGGGCTC TAGAGCCTCT

14401 GTGCTATGCC CAGCTTATTG TTGTTGTTTT TTTAAATTTT TTTTTTTGTA

14451 CAGATGGGGT CTCACTATGT GGCCCAAGGT GGTCTTAAAC TCCTGGCTCC

14501 AAGAGATCCT CCCACCTCAG CCTCCCAAAG TGCAGGGATT ACAGGTGTGA

14551 GCCACTGTGC CCAGCCTAGA CAGCATTTTT TTTTTTTGAA ACAGGGTCTC

14601 CCTCTGTTGC CCAGGCTGGA GTGCAATGGC GTGTTCATGG TTCACTGCAG

14651 CCTCAGCCTC CTCAGTCTCA AGCAATCCTC CAACTTCAGC CTCCCCCAAC

14701 AGCTAGAACT GCAGGTGATC ATCACCAATT AGCCTGGTTA ATTGTGTGTG

14751 TATTTCTTAA ATTTTTTGTA GAGATAGTTC TCACTATATT GCTTGGGCTG

14801 GTCTCAAACT CCTGGACTCA AGTGATTCAC CTACCTCGGC CTCCCTAAGC

14851 ACTGGGATTA CAGGCTTGAG CCACCACACC CGGCAAGGAC TAGGTTTTAA

14901 AATAGGTTCC TAGGCTGGGT GTGGTGGCTT ACGCCCGTAA TCCCAGCACT

14951 TTGGGAGGCT GAGGTGGGCG GATCACGAGG TCAGGAGTTT GAGACCAGCC

15001 TGGCCAACAT AGTGAAACCC TGTCTCTACT AAAAATACAA AAAATTAGCT

15051 GGGCATAGTG GCACACACCT GTAATCCCAG CTACTCGGGA GGCTGAGGAA

15101 GGAGAATCAC TTGAACCTGG GAGGCGGAGG TTGCAGTGAG CCGAGATCAT

15151 GCCATTGCTC TCCAGCCTGG GTGACAGAGC AAGACTCCAT CTAAAAAAAA

15201 AAAAAAAAGT TCCTTTGACT TCTTGACACT CTTCTCTGAG GATATTGATC

15251 ATTTTTCCCC AATAGATGTT ACTAATTGAA CACTTCTGTT GCTTCAACTT

15301 ACTAATTTAC ATGATCAATA GCCAATTAAT TCAGCAGGAG AGAATGCTAC

15351 AGAGTCGATT CTTTCTGTAC TTTCTTCTGC TCCAGAGTGA AGGATCTTTC

15401 TAAATCAGAG ACCATCACTG TGTTCACAGG GAGGGCCTAG GTGAACCTGA

15451 GATGGCAAAT GTTGCGTTTG TTCTACGGAA GAAGGGATTA TGGGTTGAAG

15501 TCCTTGGCAG TGCCAAATTG CTTAGAAAAA TGTGAAATAT GGTCCCTAGG

15551 AGTGCTCTTG GGATGTCACA TTTTTCTCAC TCCTTTGACA GGTAGATGTT

15601 ATTTTCCTGA AGGCCAGGGA AAGGATTCAG AGGGAGGAAT GAATTTGAAA

15651 GAAAATGAAG GTGACGAGAA AGAATGAGCT CATCTCCCTT ATCCTCTTTC

15701 TTCTCAAATC CTTAAGTAGC TTTGCAGTGA ACTAAGATTT GGGGGAACCT

15751 AGAGGAGGCT GAAAGTTGGA AGCTGAAATT GGCTTAGCAA GGGCAAGCTC

15801 CAAAGACAAA AGTGGAAATA GTTTGGGGGT AGCCTTTTGC ATGGGTGAAA

15851 TCCTGGTTCA TCACATCCTC CCTTATGCAA AGAGCCCTTT TATATGGGGC

15901 ATGGGAAAAA ACTGAGCTAA AGGTGATAAT TTCTCCTGAG CAAGCCAGAT

15951 GGTCAAAGCT CTAACTTCAC CATCTCCCTT GGAATGTTTA ATGTGTTCCC

16001 TGGTGTCCAG AGGCTTAACG TGTGAGAATT AAAAGCTCAA CATTTTCTTT

16051 CCCAGGGAAG GAGGAAATAG TTTTAATTGA AATCCCGGGA GGAAATGAAT
```

TABLE 27-continued

Genomic CA125 Amino Terminal Sequence
(SEQ ID NO: 311)

```
16101  GATAGTGTCA AACCAAAAAA CTTCATCTTC TGTACCACTT GCATATACTC

Exon 3
16151  CACTGACTTA CTTTCTAATC ACAGGCACAT CCCCAGGAAG CCCAGAAATG

16201  TCTACCACTC TCAAAATCAT GAGCTCCAAG GAACCCGGCA TCAGCCCAGA

16251  GATCAGGTCC ACTGTGAGAA ATTCTCCTTG GAAGACTCCA GAAACAACTG

16301  TTCCCATGGA GACCACAGTG GAACCAGTCA CCCTTCAGTC CACAGCCCTA

16351  GGAAGTGGCA GCACCAGCAT CTCTCACCTG CCCACAGGAA CCACATCACC

16401  AACCAAGTCA CCAACAGAAA ATATGTTGGC TACAGAAAGG GTCTCCCTCT

16451  CCCCATCCCC ACCTGAGGCT TGGACCAACC TTTATTCTGG AACTCCAGGA

16501  GGGACCAGGC AGTCACTGGC CACAATGTCC TCTGTCTCCC TAGAGTCACC

16551  AACTGCTAGA AGCATCACAG GGACTGGTCA GCAAAGCAGT CCAGAACTGG

16601  TTTTAAAGAC AACTGGAATG GAATTCTCTA TGTGGCATGG CTCTACTGGA

16651  GGGACCACAG GGACACACA TGTCTCTCTG AGCACATCTT CCAATATCCT

16701  TGAAGACCCT GTAACCAGCC CAAACTCTGT GAGCTCATTG ACAGATAAAT

16751  CCAAACATAA AACCGAGACA TGGGTCAGCA CCACAGCCAT TCCCTCCACT

16801  GTCCTGAATA ATAAGATAAT GGCAGCTGAA CAACAGACAA GTCGATCTGT

16851  GGATGAGGCT TATTCATCAA CTAGTTCTTG GTCAGATCAG ACATCTGGGA

16901  GTGACATCAC CCTTGGTGCA TCTCCTGATG TCACAAACAC ATTATACATC

16951  ACCTCCACAG CACAAACCAC CTCACTAGTA TCTCTGCCCT CTGGAGACCA

17001  AGGCATTACA AGCCTCACCA ATCCCTCAGG AGGAAAAACA AGCTCTGCAT

17051  CATCTGTCAC ATCTCCTTCA ATAGGGCTTG AGACTCTGAT GGCCAATGTA

17101  AGTGCAGTGA CAAGTGACAT TGCCCCTACT GCTGGGCATC TATCTCAGAC

17151  TTCATCTCCT GCGGAAGTGA GCATCCTGGA CATAACCACA GCTCCTACTC

17201  CAGGTATCTC CACCACCATC ACCACCATGG GAACCAACTC AATCTCAACT

17251  ACCACACCCA ACCCAGAAGT GGGTATGAGT ACCATGGACA GCACCCCGGC

17301  CACAGAGAGG CACACAACTT CTACAGAACA CCCTTCCACC TGGTCTTCCA

17351  CAGCTGCATC AGATTCCTGG ACTGTCACAG ACATGACTTC AAACTTGAAA

17401  GTTGCAAGAT CTCCTGGAAC AATTTCCACA ATGCATACAA CTTCATTCTT

17451  AGCCTCAAGC ACTGAATTAG ACTCCATGTC TACTCCCCAT GGCCGTATAA

17501  CTGTCATTGG AACCAGCCTG GTCACTCCAT CCTCTGATGC TTCAGCTGTA

17551  AAGACAGAGA CCAGTACAAG TGAAAGAACA TTGAGTCCTT CAGACACAAC

17601  TGCATCTACT CCCATCTCAA CTTTTTCTCG TGTCCAGAGG ATGAGCATCT

17651  CAGTTCCTGA CATTTTAAGT ACAAGTTGGA CTCCCAGTAG TACAGAAGCA

17701  GAAGATGTGC CTGTTTCAAT GGTTTCTACA GATCATGCTA GTACAAAGAC

17751  TGACCCAAAT ATGCCCCTGT CCACTTTTCT GTTTGATTCT CTGTCCACTC

17801  TTGACTGGGA CACTGGGAGA TCTCTGTCAT CAGCCACAGC CACTACCTCA

17851  GCTCCTCAGG GGGCCACAAC TCCCCAAGAA CTCACTTTGG AAACCATGAT

17901  CAGCCCAGCT ACCTCACAGT TGCCCTTCTC TATAGGGCAC ATTACAAGTG

17951  CAGTCATACC AGCTGCAATG GCAAGGAGCT CTGGAGTTAC TTTTTCAAGA
```

TABLE 27-continued

Genomic CA125 Amino Terminal Sequence
(SEQ ID NO: 311)

```
18001  CCAGATCCCA CAAGCAAAAA GGCAGAGCAG ACTTCCACTC AGCTTCCCAC
18051  CACCACTTCT GCACATCCAG AGCAGGTGCC CAGATCAGCA GCAACAACTC
18101  TGGATGTGAT CCCACACACA GCAAAAACTC CAGATGCAAC TTTTCAGAGA
18151  CAAGGGCAGA CAGCTCTTAC AACAGAGGCA AGAGCTACAT CTGACTCCTG
18201  GAATGAGAAA GAAAAATCAA CCCCAAGTGC ACCTTGGATC ACTGAGATGA
18251  TGAATTCTGT CTCAGAAGAT ACCATCAAGG AGGTTACCAG CTCCTCCAGT
18301  GTGTTAAGGA CCCTGAATAC GCTGGACATA AACTTGGAAT CTGGACGAC
18351  TTCATCCCCA AGTTGGAAAA GCAGCCCATA TGAGAGAATT GCCCCTTCTG
18401  AGTCTACCAC AGACAAAGAG GCAATTCACC CTTCTACAAA CACAGTAGAG
18451  ACCACTGGCT GGGTCACAAG TTCCGAACAT GCTTCTCATT CCACTATCCC
18501  AGCCCACTCA GCGTCATCCA AACTCACATC TCCAGTGGTT ACAACCTCCA
18551  CCAGGGAACA AGCAATAGTT TCTATGTCAA CAACCACATG GCCAGAGTCT
18601  ACAAGGGCTA GAACAGAGCC TAATTCCTTC TTGACTATTG AACTGAGGGA
18651  CGTCAGCCCT TACATGGACA CCAGCTCAAC CACACAAACA AGTTTTATCT
18701  CTTCCCCAGG TTCCACTGCG ATCACCAAGG GGCCTAGAAC AGAAATTACC
18751  TCCTCTAAGA GAATATCCAG CTCATTCCTT GCCCAGTCTA TGAGGTCGTC
18801  AGACAGCCCC TCAGAAGCCA TCTCCAGGCT GTCTAACTTT CCTGCCATGA
18851  CAGAATCTGG AGGAATGATC CTTGCTATGC AAACAAGTCC ACCTGGCGCT
18901  ACATCACTAA GTGCACCTAC TTTGGATACA TCAGCCACAG CCTCCTGGAC
18951  AGGGACTCCA CTGGCTACGA CTCAGAGATT TACATACTCA GAGAAGACCA
19001  CTCTCTTTAG CAAAGGTCCT GAGGATACAT CACAGCCAAG CCCTCCCTCT
19051  GTGGAAGAAA CCAGCTCTTC CTCTTCCCTG GTACCTATCA ATGCTACAAC
19101  CTCGCCTTCC AATATTTTGT TGACATCACA AGGGCACAGT CCCTCCTCTA
19151  CTCCACCTGT GACCTCAGTT TTCTTGTCTG AGACCTCTGG CCTGGGGAAG
19201  ACCACAGACA TGTCGAGGAT AAGCTTGGAA CCTGGCACAA GTTTACCTCC
19251  CAATTTGAGC AGTACAGCAG GTGAGGCGTT ATCCACTTAT GAAGCCTCCA
19301  GAGATACAAA GGCAATTCAT CATTCTGCAG ACACAGCAGT GACGAATATG
19351  GAGGCAACCA GTTCTGAATA TTCTCCTATC CCAGGCCATA CAAAGCCATC
19401  CAAAGCCACA TCTCCATTGG TTACCTCCCA CATCATGGGG GACATCACTT
19451  CTTCCACATC AGTATTTGGC TCCTCCGAGA CCACAGAGAT TGAGACAGTG
19501  TCCTCTGTGA ACCAGGGACT TCAGGAGAGA AGCACATCCC AGGTGGCCAG
19551  CTCTGCTACA GAGACAAGCA CTGTCATTAC CCATGTGTCT AGTGGTGATG
19601  CTACTACTCA TGTCACCAAG ACACAAGCCA CTTTCTCTAG CGGAACATCC
19651  ATCTCAAGCC CTCATCAGTT TATAACTTCT ACCAACACAT TTACAGATGT
19701  GAGCACCAAC CCCTCCACCT CTCTGATAAT GACAGAATCT TCAGGAGTGA
19751  CCATCACCAC CCAAACAGGT CCTACTGGAG CTGCAACACA GGGTCCATAT
19801  CTCTTGGACA CATCAACCAT GCCTTACTTG ACAGAGACTC CATTAGCTGT
19851  GACTCCAGAT TTTATGCAAT CAGAGAAGAC CACTCTCATA AGCAAGGTC
```

TABLE 27-continued

Genomic CA125 Amino Terminal Sequence
(SEQ ID NO: 311)

| | |
|---|---|
| 19901 | CCAAGGATGT GTCCTGGACA AGCCCTCCCT CTGTGGCAGA AACCAGCTAT |
| 19951 | CCCTCTTCCC TGACACCTTT CTTGGTCACA ACCATACCTC CTGCCACTTC |
| 20001 | CACGTTACAA GGGCAACATA CATCCTCTCC TGTTTCTGCG ACTTCAGTTC |
| 20051 | TTACCTCTGG ACTGGTGAAG ACCACAGATA TGTTGAACAC AAGCATGGAA |
| 20101 | CCTGTGACCA ATTCACCTCA AAATTTGAAC AATCCATCAA ATGAGATACT |
| 20151 | GGCCACTTTG GCAGCCACCA CAGATATAGA GACTATTCAT CCTTCCATAA |
| 20201 | ACAAAGCAGT GACCAATATG GGGACTGCCA GTTCAGCACA TGTACTGCAT |
| 20251 | TCCACTCTCC CAGTCAGCTC AGAACCATCT ACAGCCACAT CTCCAATGGT |
| 20301 | TCCTGCCTCC AGCATGGGGG ACGCTCTTGC TTCTATATCA ATACCTGGTT |
| 20351 | CTGAGACCAC AGACATTGAG GGAGAGCCAA CATCCTCCCT GACTGCTGGA |
| 20401 | CGAAAAGAGA ACAGCACCCT CCAGGAGATG AACTCAACTA CAGAGTCAAA |
| 20451 | CATCATCCTC TCCAATGTGT CTGTGGGGGC TATTACTGAA GCCACAAAAA |
| 20501 | TGGAAGTCCC CTCTTTTGAT GCAACATTCA TACCAACTCC TGCTCAGTCA |
| 20551 | ACAAAGTTCC CAGATATTTT CTCAGTAGCC AGCAGTAGAC TTTCAAACTC |
| 20601 | TCCTCCCATG ACAATATCTA CCCACATGAC CACCACCCAG ACAGGGTCTT |
| 20651 | CTGGAGCTAC ATCAAAGATT CCACTTGCCT TAGACACATC AACCTTGGAA |
| 20701 | ACCTCAGCAG GGACTCCATC AGTGGTGACT GAGGGGTTTG CCCACTCAAA |
| 20751 | AATAACCACT GCAATGAACA ATGATGTCAA GGACGTGTCA CAGACAAACC |
| 20801 | CTCCCTTTCA GGATGAAGCC AGCTCTCCCT CTTCTCAAGC ACCTGTCCTT |
| 20851 | GTCACAACCT TACCTTCTTC TGTTGCTTTC ACACCGCAAT GGCACAGTAC |
| 20901 | CTCCTCTCCT GTTTCTATGT CCTCAGTTCT TACTTCTTCA CTGGTAAAGA |
| 20951 | CCGCAGGCAA GGTGGATACA AGCTTAGAAA CAGTGACCAG TTCACCTCAA |
| 21051 | AGATATAGAG ACAACGCATC CTTCCATAAA CACAGTAGTT ACCAATGTGG |
| 21101 | GGACCACCGG TTCAGCATTT GAATCACATT CTACTGTCTC AGCTTACCCA |
| 21151 | GAGCCATCTA AAGTCACATC TCCAAATGTT ACCACCTCCA CCATGGAAGA |
| 21201 | CACCACAATT TCCAGATCAA TACCTAAATC CTCTAAGACT ACAAGAACTG |
| 21251 | AGACTGAGAC AACTTCCTCC CTGACTCCTA AACTGAGGGA GACCAGCGTC |
| 21301 | TCCCAGGAGA TCACCTCGTC CACAGAGACA AGCACTGTTC CTTACAAAGA |
| 21351 | GCTCACTGGT GCCACTACCG AGGTATCCAG ACAGATGTC ACTTCCTCTA |
| 21401 | GCAGTACATC CTTCCCTGGC CCTGATCAGT CCACAGTGTC ACTAGACATC |
| 21451 | TCCACAGAAA CCAACACCAG GCTGTCTACC TCCCCAATAA TGACAGAATC |
| 21501 | TGCAGAAATA ACCATCACCA CCCAAACAGG TCCTCATGGG CTACATCAC |
| 21551 | AGGATACTTT TACCATGGAC CCATCAAATA CAACCCCCCA GGCAGGGATC |
| 21601 | CACTCAGCTA TGACTCATGG ATTTTCACAA TTGGATGTGA CCACTCTTAT |
| 21651 | GAGCAGAATT CCACAGGATG TATCATGGAC AAGTCCTCCC TCTGTGGATA |
| 21701 | AAACCAGCTC CCCCTCTTCC TTTCTGCCCT CACCTGCAAT GACCACACCT |
| 21751 | TCCCTGATTT CTTCTACCTT ACCAGAGGAT AAGCTCTCCT CTCCTATGAC |
| 21801 | TTCACTTCTC ACCTCTGGCC TAGTGAAGAT TACAGACATA TTACGTACAC |
| 21851 | GCTTGGAACC TGTGACCAGC TCACTTCCAA ATTTCAGCAG CACCTCAGAT |

TABLE 27-continued

Genomic CA125 Amino Terminal Sequence
(SEQ ID NO: 311)

```
21901  AAGATACTGG CCACTTCTAA AGACAGTAAA GACACAAAGG AAATTTTTCC
21951  TTCTATAAAC ACAGAAGAGA CCAATGTGAA AGCCAACAAC TCTGGACATG
22001  AATCCCATTC CCCTGCACTG GCTGACTCAG AGACACCCAA AGCCACAACT
22051  CAAATGGTTA TCACCACCAC TGTGGGAGAT CCAGCTCCTT CCACATCAAT
22101  GCCAGTGCAT GGTTCCTCTG AGACTACAAA CATTAAGAGA GAGCCAACAT
22151  ATTTCTTGAC TCCTAGACTG AGAGAGACCA GTACCTCTCA GGAGTCCAGC
22201  TTTCCCACGG ACACAAGTTT TCTACTTTCC AAAGTCCCCA CTGGTACTAT
22251  TACTGAGGTC TCCAGTACAG GGGTCATCTC TTCTAGCAAA ATTTCCACCC
22301  CAGACCATGA TAAGTCCACA GTGCCACCTG ACACCTTCAC AGGAGAGATC
22351  CCCAGGGTCT TCACCTCCTC TATTAAGACA AAATCTGCAG AAATGACGAT
22401  CACCACCCAA GCAAGTCCTC CTGAGTCTGC ATCGCACAGT ACCCTTCCCT
22451  TGGACACATC AACCACACTT TCCCAGGGAG GGACTCATTC AACTGTGACT
22501  CAGGGATTCC CATACTCAGA GGTGACCACT CTCATGGGCA TGGGTCCTGG
22551  GAATGTGTCA TGGATGACAA CTCCCCCTGT GGAAGAAACC AGCTCTGTGT
22601  CTTCCCTGAT GTCTTCACCT GCCATGACAT CCCCTTCTCC TGTTTCCTCC
22651  ACATCACCAC AGAGCATCCC CTCCTCTCCT CTTCCTGTGA CTGCACTTCC
22701  TACTTCTGTT CTGGTGACAA CCACAGATGT GTTGGGCACA ACAAGCCCAG
22751  AGTCTGTAAC CAGTTCACCT CCAAATTTGA GCAGCATCAC TCATGAGAGA
22801  CCGGCCACTT ACAAAGACAC TGCACACACA GAAGCCGCCA TGCATCATTC
22851  CACAAACACC GCAGTGACCA ATGTAGGGAC TTCCGGGTCT GGACATAAAT
22901  CACAATCCTC TGTCCTAGCT GACTCAGAGA CATCGAAAGC CACACCTCTG
22951  ATGAGTACCA CCTCCACCCT GGGGGACACA AGTGTTTCCA CATCAACTCC
23001  TAATATCTCT CAGACTAACC AAATTCAAAC AGAGCCAACA GCATCCCTGA
23051  GCCCTAGACT GAGGGAGAGC AGCACGTCTG AGAAGACCAG CTCAACAACA
23101  GAGACAAATA CTGCCTTTTC TTATGTGCCC ACAGGTGCTA TTACTCAGGC
23151  CTCCAGAACA GAAATCTCCT CTAGCAGAAC ATCCATCTCA GACCTTGATC
23201  GGTCCACAAT AGCACCCGAC ATCTCCACAG GAATGATCAC CAGGCTCTTC
23251  ACCTCCCCCA TCATGACAAA ATCTGCAGAA ATGACCGTCA CCACTCAAAC
23301  AACTACTCCT GGGGCTACAT CACAGGGTAT CCTTCCCTGG ACACATCAA
23351  CCACACTTTT CCAGGGAGGG ACTCATTCAA CCGTGTCTCA GGGATTCCCA
23401  CACTCAGAGA TAACCACTCT TCGGAGCAGA ACCCCTGGAG ATGTGTCATG
23451  GATGACAACT CCCCCTGTGG AAGAAACCAG CTCTGGGTTT TCCCTGATGT
23501  CACCTTCCAT GACATCCCCT TCTCCTGTTT CCTCCACATC ACCAGAGAGC
23551  ATCCCCTCCT CTCCTCTCCC TGTGACTGCA CTTCTTACTT CTGTTCTGGT
23601  GACAACCACA AATGTATTGG GCACAACAAG CCCAGAGCCC GTAACGAGTT
23651  CACCTCCAAA TTTAAGCAGC CCCACACAGG AGAGACTGAC CACTTACAAA
23701  GACACTGCGC ACACAGAAGC CATGCATGCT TCCATGCATA CAAACACTGC
23751  AGTGGCCAAC GTGGGGACCT CCATTTCTGG ACATGAATCA CAATCTTCTG
```

TABLE 27-continued

Genomic CA125 Amino Terminal Sequence
(SEQ ID NO: 311)

```
23801  TCCCAGCTGA TTCAGACACA TCCAAAGCCA CATCTCCAAT GGGTACCACC
23851  TTCGCCATGG GGGATACAAG TGTTTCTACA TCAACTCCTG CCTTCTTTGA
23901  GACTAGAATT CAGACTGAAT CAACATCCTC TTTGATTCCT GGATTAAGGG
23951  ACACCAGGAC GTCTGAGGAG ATCAACACTG TGACAGAGAC CAGCACTGTC
24001  CTTTCAGAAG TGCCCACTAC TACTACTACT GAGGTCTCCA GGACAGAAGT
24051  TATCACTTCC AGCAGAACAA CCATCTCAGG GCCTGATCAT TCCAAAATGT
24101  CACCCTACAT CTCCACAGAA ACCATCACCA GGCTCTCCAC TTTTCCTTTT
24151  GTAACAGGAT CCACAGAAAT GGCCATCACC AACCAAACAG GTCCTATAGG
24201  GACTATCTCA CAGGCTACCC TTACCCTGGA CACATCAAGC ACAGCTTCCT
24251  GGGAAGGGAC TCACTCACCT GTGACTCAGA GATTTCCACA CTCAGAGGAG
24301  ACCACTACTA TGAGCAGAAG TACTAAGGGC GTGTCATGGC AAAGCCCTCC
24351  CTCTGTGGAA GAAACCAGTT CTCCTTCTTC CCCAGTGCCT TTACCTGCAA
24401  TAACCTCACA TTCATCTCTT TATTCCGCAG TATCAGGAAG TAGCCCCACT
24451  TCTGCTCTCC CTGTGACTTC CCTTCTCACC TCTGGCAGGA GGAAGACCAT
24501  AGACATGTTG GACACACACT CAGAACTTGT GACCAGCTCC TTACCAAGTG
24551  CAAGTAGCTT CTCAGGTGAG ATACTCACTT CTGAAGCCTC CACAAATACA
24601  GAGACAATTC ACTTTTCAGA GAACACAGCA GAAACCAATA TGGGGACCAC
24651  CAATTCTATG CATAAACTAC ATTCCTCTGT CTCAATCCAC TCCCAGCCAT
24701  CCGGACACAC ACCTCCAAAG GTTACTGGAT CTATGATGGA GGACGCTATT
24751  GTTTCCACAT CAACACCTGG TTCTCCTGAG ACTAAAAATG TTGACAGAGA
24801  CTCAACATCC CCTCTGACTC CTGAACTGAA AGAGGACAGC ACCGCCCTGG
24851  TGATGAACTC AACTACAGAG TCAAACACTG TTTTCTCCAG TGTGTCCCTG
24901  GATGCTGCTA CTGAGGTCTC CAGGGCAGAA GTCACCTACT ATGATCCTAC
24951  ATTCATGCCA GCTTCTGCTC AGTCAACAAA GTCCCCAGAC ATTTCACCTG
25001  AAGCCAGCAG CAGTCATTCT AACTCTCCTC CCTTGACAAT ATCTACACAC
25051  AAGACCATCG CCACACAAAC AGGTCCTTCT GGGGTGACAT CTCTTGGCCA
25101  ACTGACCCTG GACACATCAA CCATAGCCAC CTCAGCAGGA ACTCCATCAG
25151  CCAGAACTCA GGATTTTGTA GATTCAGAAA CAACCAGTGT CATGAACAAT
25201  GATCTCAATG ATGTGTTGAA GACAAGCCCT TTCTCTGCAG AAGAAGCCAA
25251  CTCTCTCTCT TCTCAGGCAC CTCTCCTTGT GACAACCTCA CCTTCTCCTG
25301  TAACTTCCAC ATTGCAAGAG CACAGTACCT CCTCTCTTGT TTCTGTGACC
25351  TCAGTACCCA CCCCTACACT GGCGAAGATC ACAGACATGG ACACAAACTT
25401  AGAACCTGTG ACTCGTTCAC CTCAAAATTT AAGGAACACC TTGGCCACTT
25451  CAGAAGCCAC CACAGATACA CACACAATGC ATCCTTCTAT AAACACAGCA
25501  GTGGCCAATG TGGGGACCAC CAGTTCACCA AATGAATTCT ATTTTACTGT
25551  CTCACCTGAC TCAGACCCAT ATAAAGCCAC ATCCGCAGTA GTTATCACTT
25601  CCACCTCGGG GGACTCAATA GTTTCCACAT CAATGCCTAG ATCCTCTGCG
25651  ATGAAAAAGA TTGAGTCTGA GACAACTTTC TCCCTGATAT TTAGACTGAG
25701  GGAGACTAGC ACCTCCCAGA AAATTGGCTC ATCCTCAGAC ACAAGCACGG
```

TABLE 27-continued

Genomic CA125 Amino Terminal Sequence
(SEQ ID NO: 311)

```
25751 TCTTTGACAA AGCATTCACT GCTGCTACTA CTGAGGTCTC CAGAACAGAA
25801 CTCACCTCCT CTAGCAGAAC ATCCATCCAA GGCACTGAAA AGCCCACAAT
25851 GTCACCGGAC ACCTCCACAA GATCTGTCAC CATGCTTTCT ACTTTTGCTG
25901 GCCTGACAAA ATCCGAAGAA AGGACCATTG CCACCCAAAC AGGTCCTCAT
25951 AGGGCGACAT CACAGGGTAC CCTTACCTGG GACACATCAA TCACAACCTC
26001 ACAGGCAGGG ACCCACTCAG CTATGACTCA TGGATTTTCA CAATTAGATT
26051 TGTCCACTCT TACGAGTAGA GTTCCTGAGT ACATATCAGG GACAAGCCCA
26101 CCCTCTGTGG AAAAAACCAG CTCTTCCTCT TCCCTTCTGT CTTTACCAGC
26151 AATAACCTCA CCGTCCCCTG TACCTACTAC ATTACCAGAA AGTAGGCCGT
26201 CTTCTCCTGT TCATCTGACT TCACTCCCCA CCTCTGGCCT AGTGAAGACC
26251 ACAGATATGC TGGCATCTGT GGCCAGTTTA CCTCCAAACT TGGGCAGCAC
26301 CTCACATAAG ATACCGACTA CTTCAGAAGA CATTAAAGAT ACAGAGAAAA
26351 TGTATCCTTC CACAAACATA GCAGTAACCA ATGTGGGGAC CACCACTTCT
26401 GAAAAGGAAT CTTATTCGTC TGTCCCAGCC TACTCAGAAC CACCCAAAGT
26451 CACCTCTCCA ATGGTTACCT CTTTCAACAT AAGGGACACC ATTGTTTCCA
26501 CATCCATGCC TGGCTCCTCT GAGATTACAA GGATTGAGAT GGAGTCAACA
26551 TTCTCCCTGG CTCATGGGCT GAAGGGAACC AGCACCTCCC AGGACCCCAT
26601 CGTATCCACA GAGAAAAGTG CTGTCCTTCA CAAGTTGACC ACTGGTGCTA
26651 CTGAGACCTC TAGGACAGAA GTTGCCTCTT CTAGAAGAAC ATCCATTCCA
26701 GGCCCTGATC ATTCCACAGA GTCACCAGAC ATCTCCACTG AAGTGATCCC
26751 CAGCCTGCCT ATCTCCCTTG GCATTACAGA ATCTTCAAAT ATGACCATCA
26801 TCACTCGAAC AGGTCCTCCT CTTGGCTCTA CATCACAGGG CACATTTACC
26851 TTGGACACAC CAACTACATC CTCCAGGGCA GGAACACACT CGATGGCGAC
26901 TCAGGAATTT CCACACTCAG AAATGACCAC TGTCATGAAC AAGGACCCTG
26951 AGATTCTATC ATGGACAATC CCTCCTTCTA TAGAGAAAAC CAGCTTCTCC
27001 TCTTCCCTGA TGCCTTCACC AGCCATGACT TCACCTCCTG TTTCCTCAAC
27051 ATTACCAAAG ACCATTCACA CCACTCCTTC TCCTATGACC TCACTGCTCA
27101 CCCCTAGCCT AGTGATGACC ACAGACACAT TGGGCACAAG CCCAGAACCT
27151 ACAACCAGTT CACCTCCAAA TTTGAGCAGT ACCTCACATG AGATACTGAC
27201 AACAGATGAA GACACCACAG CTATAGAAGC CATGCATCCT TCCACAAGCA
27251 CAGCAGCGAC TAATGTGGAA ACCACCAGTT CTGGACATGG GTCACAATCC
27301 TCTGTCCTAG CTGACTCAGA AAAAACCAAG GCCACAGCTC CAATGGATAC
27351 CACCTCCACC ATGGGGCATA CAACTGTTTC CACATCAATG TCTGTTTCCT
27401 CTGAGACTAC AAAAATTAAG AGAGAGTCAA CATATTCCTT GACTCCTGGA
27451 CTGAGAGAGA CCAGCATTTC CCAAAATGCC AGCTTTTCCA CTGACACAAG
27501 TATTGTTCTT TCAGAAGTCC CCACTGGTAC TACTGCTGAG GTCTCCAGGA
27551 CAGAAGTCAC CTCCTCTGGT AGAACATCCA TCCCTGGCCC TTCTCAGTCC
27601 ACAGTTTTGC CAGAAATATC CACAAGAACA ATGACAAGGC TCTTTGCCTC
```

TABLE 27-continued

Genomic CA125 Amino Terminal Sequence
(SEQ ID NO: 311)

```
27651  GCCCACCATG ACAGAATCAG CAGAAATGAC CATCCCCACT CAAACAGGTC
27701  CTTCTGGGTC TACCTCACAG GATACCCTTA CCTTGGACAC ATCCACCACA
27751  AAGTCCCAGG CAAAGACTCA TTCAACTTTG ACTCAGAGAT TTCCACACTC
27801  AGAGATGACC ACTCTCATGA GCAGAGGTCC TGGAGATATG TCATGGCAAA
27851  GCTCTCCCTC TCTGGAAAAT CCCAGCTCTC TCCCTTCCCT GCTGTCTTTA
27901  CCTGCCACAA CCTCACCTCC TCCCATTTCC TCCACATTAC CAGTGACTAT
27951  CTCCTCCTCT CCTCTTCCTG TGACTTCACT TCTCACCTCT AGCCCGGTAA
28001  CGACCACAGA CATGTTACAC ACAAGCCCAG AACTTGTAAC CAGTTCACCT
28051  CCAAAGCTGA GCCACACTTC AGATGAGAGA CTGACCACTG GCAAGGACAC
28101  CACAAATACA GAAGCTGTGC ATCCTTCCAC AAACACAGCA GCGTCCAATG
28151  TGGAGATTCC CAGCTCTGGA CATGAATCCC CTTCCTCTGC CTTAGCTGAC
28201  TCAGAGACAT CCAAAGCCAC ATCACCAATG TTTATTACCT CCACCCAGGA
28251  GGATACAACT GTTGCCATAT CAACCCCTCA CTTCTTGGAG ACTAGCAGAA
28301  TTCAGAAAGA GTCAATTTCC TCCCTGAGCC CTAAATTGAG GGAGACAGGC
28351  AGTTCTGTGG AGACAAGCTC AGCCATAGAG ACAAGTGCTG TCCTTTCTGA
28401  AGTGTCCGTT GGTGCTACTA CTGAGATCTC CAGGACAGAA GTCACCTCCT
28451  CTAGCAGAAC ATCCATCTCT GGTTCTGCTG AGTCCACAAT GTTGCCAGAA
28501  ATATCCACCA CAAGAAAAAT CATTAAGTTC CCTACTTCCC CCATCCTGGC
28551  AGAATCATCA GAAATGACCA TCAAGACCCA AACAAGTCCT CCTGGGTCTA
28601  CATCAGAGAG TACCTTTACA TTAGACACAT CAACCACTCC CTCCTTGGTA
28651  ATAACCCATT CGACTATGAC TCAGAGATTG CCACACTCAG AGATAACCAC
28701  TCTTGTGAGT AGAGGTGCTG GGGATGTGCC ACGGCCCAGC TCTCTCCCTG
28751  TGGAAGAAAC AAGCCCTCCA TCTTCCCAGC TGTCTTTATC TGCCATGATC
28801  TCACCTTCTC CTGTTTCTTC CACATTACCA GCAAGTAGCC ACTCCTCTTC
28851  TGCTTCTGTG ACTTCACTTC TCACACCAGG CCAAGTGAAG ACTACTGAGG
28901  TGTTGGACGC AAGTGCAGAA CCTGAAACCA GTTCACCTCC AAGTTTGAGC
28951  AGCACCTCAG TTGAAATACT GGCCACCTCT GAAGTCACCA CAGATACGGA
29001  GAAAATTCAT CCTTTCTCAA ACACGGCAGT AACCAAAGTT GGAACTTCCA
29051  GTTCTGGACA TGAATCCCCT TCCTCTGTCC TACCTGACTC AGAGACAACC
29101  AAAGCCACAT CGGCAATGGG TACCATCTCC ATTATGGGGG ATACAAGTGT
29151  TTCTACATTA ACTCCTGCCT TATCTAACAC TAGGAAAATT CAGTCAGAGC
29201  CAGCTTCCTC ACTGACCACC AGATTGAGGG AGACCAGCAC CTCTGAAGAG
29251  ACCAGCTTAG CCACAGAAGC AAACACTGTT CTTTCTAAAG TGTCCACTGG
29301  TGCTACTACT GAGGTCTCCA GGACAGAAGC CATCTCCTTT AGCAGAACAT
29351  CCATGTCAGG CCCTGAGCAG TCCACAATGT CACAAGACAT CTCCATAGGA
29401  ACCATCCCCA GGATTTCTGC CTCCTCTGTC CTGACAGAAT CTGCAAAAAT
29451  GACCATCACA ACCCAAACAG GTCCTTCGGA GTCTACACTA GAAAGTACCC
29501  TTAATTTGAA CACAGCAACC ACACCCTCTT GGGTGGAAAC CCACTCTATA
29551  GTAATTCAGG GATTTCCACA CCCAGAGATG ACCACTTCCA TGGGCAGAGG
```

TABLE 27-continued

Genomic CA125 Amino Terminal Sequence
(SEQ ID NO: 311)

```
29601  TCCTGGAGGT GTGTCATGGC CTAGCCCTCC CTTTGTGAAA GAAACCAGCC
29651  CTCCATCCTC CCCGCTGTCT TTACCTGCCG TGACCTCACC TCATCCTGTT
29701  TCCACCACAT TCCTAGCACA TATCCCCCCC TCTCCCTTC CTGTGACTTC
29751  ACTTCTCACC TCTGGCCCGG CGACAACCAC AGATATCTTG GGTACAAGCA
29801  CAGAACCTGG AACCAGTTCA TCTTCAAGTT TGAGCACCAC CTCCCATGAG
29851  AGACTGACCA CTTACAAAGA CACTGCACAT ACAGAAGCCG TGCATCCTTC
29901  CACAAACACA GGAGGGACCA ATGTGGCAAC CACCAGCTCT GGATATAAAT
29951  CACAGTCCTC TGTCCTAGCT GACTCATCTC CAATGTGTAC CACCTCCACC
30001  ATGGGGGATA CAAGTGTTCT CACATCAACT CCTGCCTTCC TTGAGACTAG
30051  GAGGATTCAG ACAGAGCTAG CTTCCTCCCT GACCCCTGGA TTGAGGGAGT
30101  CCAGTGGCTC TGAAGGGACC AGCTCAGGCA CCAAGATGAG CACTGTCCTC
30151  TCTAAAGTGC CCACTGGTGC TACTACTGAG ATCTCCAAGG AAGACGTCAC
30201  CTCCATCCCA GGTCCCGCTC AATCCACAAT ATCACCAGAC ATCTCCACAA
30251  GAACCGTCAG CTGGTTCTCT ACATCCCCTG TCATGACAGA ATCAGCAGAA
30301  ATAACCATGA ACACCCATAC AAGTCCTTTA GGGGCCACAA CACAAGGCAC
30351  CAGTACTTTG GCCACGTCAA GCACAACCTC TTTGACAATG ACACACTCAA
30401  CTATATCTCA AGGATTTTCA CACTCACAGA TGAGCACTCT TATGAGGAGG
30451  GGTCCTGAGG ATGTATCATG GATGAGCCCT CCCCTTCTGG AAAAAACTAG
30501  ACCTTCCTTT TCTCTGATGT CTTCACCAGC CACAACTTCA CCTTCTCCTG
30551  TTTCCTCCAC ATTACCAGAG AGCATCTCTT CCTCTCCTCT TCCTGTGACT
30601  TCACTCCTCA CGTCTGGCTT GGCAAAAACT ACAGATATGT TGCACAAAAG
30651  CTCAGAACCT GTAACCAACT CACCTGCAAA TTTGAGCAGC ACCTCAGTTG
30701  AAATACTGGC CACCTCTGAA GTCACCACAG ATACAGAGAA AACTCATCCT
30751  TCTTCAAACA GAACAGTGAC CGATGTGGGG ACCTCCAGTT CTGGACATGA
30801  ATCCACTTCC TTTGTCCTAG CTGACTCACA GACATCCAAA GTCACATCTC
30851  CAATGGTTAT TACCTCCACC ATGGAGGATA CGAGTGTCTC CACATCAACT
30901  CCTGGCTTTT TTGAGACTAG CAGAATTCAG ACAGAACCAA CATCCTCCCT
30951  GACCCTTGGA CTGAGAAAGA CCAGCAGCTC TGAGGGGACC AGCTTAGCCA
31001  CAGAGATGAG CACTGTCCTT TCTGGAGTGC CCACTGGTGC CACTGCTGAA
31051  GTCTCCAGGA CAGAAGTCAC CTCCTCTAGC AGAACATCCA TCTCAGGCTT
31101  TGCTCAGCTC ACAGTGTCAC CAGAGACTTC CACAGAAACC ATCACCAGAC
31151  TCCCTACCTC CAGCATAATG ACAGAATCAG CAGAAATGAT GATCAAGACA
31201  CAAACAGATC CTCCTGGGTC TACACCAGAG AGTACTCATA CTGTGGACAT
31251  ATCAACAACA CCCAACTGGG TAGAAACCCA CTCGACTGTG ACTCAGAGAT
31301  TTTCACACTC AGAGATGACC ACTCTTGTGA GCAGAAGCCC TGGTGATATG
31351  TTATGGCCTA GTCAATCCTC TGTGGAAGAA ACCAGCTCTG CCTCTTCCCT
31401  GCTGTCTCTG CCTGCCACGA CCTCACCTTC TCCTGTTTCC TCTACATTAG
31451  TAGAGGATTT CCCTTCCGCT TCTCTTCCTG TGACTTCTCT TCTCACCCCT
```

TABLE 27-continued

Genomic CA125 Amino Terminal Sequence
(SEQ ID NO: 311)

```
31501  GGCCTGGTGA TAACCACAGA CAGGATGGGC ATAAGCAGAG AACCTGGAAC
31551  CAGTTCCACT TCAAATTTGA GCAGCACCTC CCATGAGAGA CTGACCACTT
31601  TGGAAGACAC TGTAGATACA GAAGACATGC AGCCTTCCAC ACACACAGCA
31651  GTGACCAACG TGAGGACCTC CATTTCTGGA CATGAATCAC AATCTTCTGT
31701  CCTATCTGAC TCAGAGACAC CCAAAGCCAC ATCTCCAATG GGTACCACCT
31751  ACACCATGGG GGAAACGAGT GTTTCCATAT CCACTTCTGA CTTCTTTGAG
31801  ACCAGCAGAA TTCAGATAGA ACCAACATCC TCCCTGACTT CTGGATTGAG
31851  GGAGACCAGC AGCTCTGAGA GGATCAGCTC AGCCACAGAG GGAAGCACTG
31901  TCCTTTCTGA AGTGCCCAGT GGTGCTACCA CTGAGGTCTC CAGGACAGAA
31951  GTGATATCCT CTAGGGGAAC ATCCATGTCA GGGCCTGATC AGTTCACCAT
32001  ATCACCAGAC ATCTCTACTG AAGCGATCAC CAGGCTTTCT ACTTCCCCCA
32051  TTATGACAGA ATCAGCAGAA AGTGCCATCA CTATTGAGAC AGGTTCTCCT
32101  GGGGCTACAT CAGAGGGTAC CCTCACCTTG GACACCTCAA CAACAACCTT
32151  TTGGTCAGGG ACCCACTCAA CTGCATCTCC AGGATTTTCA CACTCAGAGA
32201  TGACCACTCT TATGAGTAGA ACTCCTGGAG ATGTGCCATG GCCGAGCCTT
32251  CCCTCTGTGG AAGAAGCCAG CTCTGTCTCT TCCTCACTGT CTTCACCTGC
32301  CATGACCTCA ACTTCTTTTT TCTCCACATT ACCAGAGAGC ATCTCCTCCT
32351  CTCCTCATCC TGTGACTGCA CTTCTCACCC TTGGCCCAGT GAAGACCACA
32401  GACATGTTGC GCACAAGCTC AGAACCTGAA ACCAGTTCAC CTCCAAATTT
32451  GAGCAGCACC TCAGCTGAAA TATTAGCCAC GTCTGAAGTC ACCAAAGATA
32501  GAGAGAAAAT TCATCCCTCC TCAAACACAC CTGTAGTCAA TGTAGGGACT
32551  GTGATTTATA AACATCTATC CCCTTCCTCT GTTTTGGCTG ACTTAGTGAC
32601  AACAAACCCC ACATCTCCAA TGGCTACCAC CTCCACTCTG GGGAATACAA
32651  GTGTTTCCAC ATCAACTCCT GCCTTCCCAG AAACTATGAT GACACAGCCA
32701  ACTTCCTCCC TGACTTCTGG ATTAAGGGAG ATCAGTACCT CTCAAGAGAC
32751  CAGCTCAGCA ACAGAGAGAA GTGCTTCTCT TTCTGGAATG CCCACTGGTG
32801  CTACTACTAA GGTCTCCAGA ACAGAAGCCC TCTCCTTAGG CAGAACATCC
32851  ACCCCAGGTC CTGCTCAATC CACAATATCA CCAGAAATCT CCACGGAAAC
32901  CATCACTAGA ATTTCTACTC CCCTCACCAC GACAGGATCA GCAGAAATGA
32951  CCATCACCCC CAAAACAGGT CATTCTGGGG CATCCTCACA AGGTACCTTT
33001  ACCTTGGACA CATCAAGCAG AGCCTCCTGG CCAGGAACTC ACTCAGCTGC
33051  AACTCACAGA TCTCCACACT CAGGGATGAC CACTCCTATG AGCAGAGGTC
33101  CTGAGGATGT GTCATGGCCA AGCCGCCCAT CAGTGGAAAA AACTAGCCCT
33151  CCATCTTCCC TGGTGTCTTT ATCTGCAGTA ACCTCACCTT CGCCACTTTA
33201  TTCCACACCA TCTGAGAGTA GCCACTCATC TCCTCTCCGG GTGACTTCTC
33251  TTTTCACCCC TGTCATGATG AAGACCACAG ACATGTTGGA CACAAGCTTG
33301  GAACCTGTGA CCACTTCACC TCCCAGTATG AATATCACCT CAGATGAGAG
33351  TCTGGCCACT TCTAAAGCCA CCATGGAGAC AGAGGCAATT CAGCTTTCAG
33401  AAAACACAGC TGTGACTCAG ATGGGCACCA TCAGCGCTAG ACAAGAATTC
```

TABLE 27-continued

Genomic CA125 Amino Terminal Sequence
(SEQ ID NO: 311)

```
33451  TATTCCTCTT ATCCAGGCCT CCCAGAGCCA TCCAAAGTGA CATCTCCAGT

33501  GGTCACCTCT TCCACCATAA AAGACATTGT TTCTACAACC ATACCTGCTT

33551  CCTCTGAGAT AACAAGAATT GAGATGGAGT CAACATCCAC CCTGACCCCC

33601  ACACCAAGGG AGACCAGCAC CTCCCAGGAG ATCCACTCAG CCACAAAGCC

33651  AAGCACTGTT CCTTACAAGG CACTCACTAG TGCCACGATT GAGGACTCCA

33701  TGACACAAGT CATGTCCTCT AGCAGAGGAC CTAGCCCTGA TCAGTCCACA

33751  ATGTCACAAG ACATATCCAG TGAAGTGATC ACCAGGCTCT CTACCTCCCC

33801  CATCAAGGCA GAATCTACAG AAATGACCAT TACCACCCAA ACAGGTTCTC

33851  CTGGGGCTAC ATCAAGGGGT ACCCTTACCT TGGACACTTC AACAACTTTT

33901  ATGTCAGGGA CCCACTCAAC TGCATCTCAA GGATTTTCAC ACTCACAGAT

33951  GACCGCTCTT ATGAGTAGAA CTCCTGGAGA TGTGCCATGG CTAAGCCATC

34001  CCTCTGTGGA AGAAGCCAGC TCTGCCTCTT TCTCACTGTC TTCACCTGTC

34051  ATGACCTCAT CTTCTCCCGT TTCTTCCACA TTACCAGACA GCATCCACTC

34101  TTCTTCGCTT CCTGTGACAT CACTTCTCAC CTCAGGGCTG GTGAAGACCA

34151  CAGAGCTGTT GGGCACAAGC TCAGAACCTG AAACCAGTTC ACCCCCAAAT

34201  TTGAGCAGCA CCTCAGCTGA ATACTGGCC ACCACTGAAG TCACTACAGA

34251  TACAGAGAAA CTGGAGATGA CCAATGTGGT AACCTCAGGT TATACACATG

34301  AATCCCTTC CTCTGTCCTA GCTGACTCAG TGACAACAAA GGCCACATCT

34351  TCAATGGGTA TCACCTACCC CACAGGAGAT ACAAATGTTC TCACATCAAC

34401  CCCTGCCTTC TCTGACACCN NNNNNNNNNN NNNNNNNNNN NNNNNNNNNN

34451  NNNNNNNNNN NNNNNNNNNN NNNNNNNNNN NNNNNNNNNN NNNNNNNNNN

34501  NNNNNNNNNN NNNNNNNNNN NNNNNNNNNN NNNNCGGAAA CCAAGTTTCT
Exon 4
34551  AACCAACCCC TCCTTTTTGA CCCCAGTAGG ATTCAAACAA AGTCAAAGCT

34601  CTCACTGACT CCTGGGTTGA TGGAGACCAG CATCTCTGAA GAGACCAGCT

34651  CTGCCACAGA AAAAGCACT GTCCTTTCTA GTGTGCCCAC TGGTGCTACT

34701  ACTGAGGTCT CCAGGACAGA AGCCATCTCT TCTAGCAGAA CATCCATCCC

34751  AGGCCCTGCT CAATCCACAA TGTCATCAGA CACCTCCATG GAAACCATCA

34801  CTAGAATTTC TACCCCCTC ACAAGGAAAG AATCAACAGA CATGGCCATC

34851  ACCCCAAAA CAGGTCCTTC TGGGGCTACC TCGCAGGGTA CCTTTACCTT

34901  GGACTCATCA AGCACAGCCT CCTGGCCAGG AACTCACTCA GCTACAACTC

34951  AGAGATTTCC ACAGTCAGTG GTGACAACTC CTATGAGCAG AGGTCCTGAG

35001  GATGTGTCAT GGCCAAGCCC GCTGTCTGTG GAAAAAAACA GCCCTCCATC

35051  TTCCCTGGTA TCTTCATCTT CAGTAACCTC ACCTTCGCCA CTTTATTCCA

35101  CACCATCTGG GAGTAGCCAC TCCTCTCCTG TCCCTGTCAC TTCTCTTTTC

35151  ACCTCTATCA TGATGAAGGC CACAGACATG TTGGATGCAA GTTTGGAACC

35201  TGAGACCACT TCAGCTCCCA ATATGAATAT CACCTCAGAT GAGAGTCTGG

35251  CCACTTCTAA AGCCACCACG GAGACAGAGG CAATTCACGT TTTTGAAAAT

35301  ACAGCAGCGT CCCATGTGGA AACCACCAGT GCTACAGAGG AACTCTATTC
```

TABLE 27-continued

Genomic CA125 Amino Terminal Sequence
(SEQ ID NO: 311)

```
35351  CTCTTCCCCA GGCTTCTCAG AGCCAACAAA AGTGATATCT CCAGTGGTCA
35401  CCTCTTCCTC TATAAGAGAC AACATGGTTT CCACAACAAT GCCTGGCTCC
35451  TCTGGCATTA CAAGGATTGA GATAGAGTCA ATGTCATCTC TGACCCCTGG
35501  ACTGAGGGAG ACCAGAACCT CCCAGGACAT CACCTCATCC ACAGAGACAA
35551  GCACTGTCCT TTACAAGATG TCCTCTGGTG CCACTCCTGA GGTCTCCAGG
35601  ACAGAAGTTA TGCCCTCTAG CAGAACATCC ATTCCTGGCC CTGCTCAGTC
35651  CACAATGTCA CTAGACATCT CCGATGAAGT TGTCACCAGG CTGTCTACCT
35701  CTCCCATCAT GACAGAATCT GCAGAAATAA CCATCACCAC CCAAACAGGT
35751  TATTCTCTGG CTACATCCCA GGTTACCCTT CCCTTGGGCA CCTCAATGAC
35801  CTTTTTGTCA GGGACCCACT CAACTATGTC TCAAGGACTT TCACACTCAG
35851  AGATGACCAA TCTTATGAGC AGGGGTCCTG AAAGTCTGTC ATGGACGAGC
35901  CCTCGCTTTG TGGAAACAAC TAGATCTTCC TCTTCTCTGA CATCATTACC
35951  TCTCACGACC TCACTTTCTC CTGTGTCCTC CACATTACTA GACAGTAGCC
36001  CCTCCTCTCC TCTTCCTGTG ACTTCACTTA TCCTCCCAGG CCTGGTGAAG
36051  ACTACAGAAG TGTTGGATAC AAGCTCAGAG CCTAAAACCA GTTCATCTCC
36101  AAATTTGAGC AGCACCTCAG TTGAAATACC GGCCACCTCT GAAATCATGA
36151  CAGATACAGA GAAAATTCAT CCTTCCTCAA ACACAGCGGT GGCCAAAGTG
36201  AGGACCTCCA GTTCTGTTCA TGAATCTCAT TCCTCTGTCC TAGCTGACTC
36251  AGAAACAACC ATAACCATAC CTTCAATGGG TATCACCTCC GCTGTGGACG
36301  ATACCACTGT TTTCACATCA AATCCTGCCT TCTCTGAGAC TAGGAGGATT
36351  CCGACAGAGC CAACATTCTC ATTGACTCCT GGATTCAGGG AGACTAGCAC
36401  CTCTGAAGAG ACCACCTCAA TCACAGAAAC AAGTGCAGTC CTTTATGGAG
36451  TGCCCACTAG TGCTACTACT GAAGTCTCCA TGACAGAAAT CATGTCCTCT
36501  AATAGAACAC ACATCCCTGA CTCTGATCAG TCCACGATGT CTCCAGACAT
36551  CATCACTGAA GTGATCACCA GGCTCTCTTC CTCATCCATG ATGTCAGAAT
36601  CAACACAAAT GACCATCACC ACCCAAAAAA GTTCTCCTGG GGCTACAGCA
36651  CAGAGTACTC TTACCTTGGC CACAACAACA GCCCCCTTGG CAAGGACCCA
36701  CTCAACTGTT CCTCCTAGAT TTTTACACTC AGAGATGACA ACTCTTATGA
36751  GTAGGAGTCC TGAAAATCCA TCATGGAAGA GCTCTCCCTT TGTGGAAAAA
36801  ACTAGCTCTT CATCTTCTCT GTTGTCCTTA CCTGTCACGA CCTCACCTTC
36851  TGTTTCTTCC ACATTACCGC AGAGTATCCC TTCCTCCTCT TTTTCTGTGA
36901  CTTCACTCCT CACCCCAGGC ATGGTGAAGA CTACAGACAC AAGCACAGAA
36951  CCTGGAACCA GTTTATCTCC AAATCTGAGT GGCACCTCAG TTGAAATACT
37001  GGCTGCCTCT GAAGTCACCA CAGATACAGA GAAAATTCAT CCTTCTTCAA
37051  GCATGGCAGT GACCAATGTG GGAACCACCA GTTCTGGACA TGAACTATAT
37101  TCCTCTGTTT CAATCCACTC GGAGCCATCC AAGGCTACAT ACCCAGTGGG
37151  TACTCCCTCT TCCATGGCTG AAACCTCTAT TTCCACATCA ATGCCTGCTA
37201  ATTTTGAGAC CACAGGATTT GAGGCTGAGC CATTTTCTCA TTTGACTTCT
```

TABLE 27-continued

Genomic CA125 Amino Terminal Sequence
(SEQ ID NO: 311)

```
37251 GGATTTAGGA AGACAAACAT GTCCCTGGAC ACCAGCTCAG TCACACCAAC

37301 AAATACACCT TCTTCTCCTG GGTCCACTCA CCTTTTACAG AGTTCCAAGA

37351 CTGATTTCAC CTCTTCTGCA AAAACATCAT CCCCAGACTG GCCTCCAGCC

37401 TCACAGTATA CTGAAATTCC AGTGGACATA ATCACCCCCT TTAATGCTTC

37451 TCCATCTATT ACGGAGTCCA CTGGGATAAC CTCCTTCCCA GAATCCAGGT

37501 TTACTATGTC TGTAACAGAA AGTACTCATC ATCTGAGTAC AGATTTGCTG

37551 CCTTCAGCTG AGACTATTTC CACTGGCACA GTGATGCCTT CTCTATCAGA

37601 GGCCATGACT TCATTTGCCA CCACTGGAGT TCCACGAGCC ATCTCAGGTT

37651 CAGGTAGTCC ATTCTCTAGG ACAGAGTCAG GCCCTGGGGA TGCTACTCTG

37701 TCCACCATTG CAGAGAGCCT GCCTTCATCC ACTCCTGTGC CATTCTCCTC

37751 TTCAACCTTC ACTACCACTG ATTCTTCAAC CATCCCAGCC CTCCATGAGA

37801 TAACTTCCTC TTCAGCTACC CCATATAGAG TGGACACCAG TCTTGGGACA

37851 GAGAGCAGCA CTACTGAAGG ACGCTTGGTT ATGGTCAGTA CTTTGGACAC

37901 TTCAAGCCAA CCAGGCAGGA CATCTTCAAC ACCCATTTTG GATACCAGAA

37951 TGACAGAGAG CGTTGAGCTG GGAACAGTGA CAAGTGCTTA TCAAGTTCCT

38001 TCACTCTCAA CACGGTTGAC AAGAGAATGC GCATGGCGAG AAGGGAGAAG

38051 TGTAGTTGGA TGGATAAAAG GAAGAATGGA GAGAAGAGTG AATGGAAGGA

38101 AGCAAAGATG AAGCGGAGGA AGGATAGATG CACAGAAGGA AGGATGAAAA

38151 GAAAGAAAGA TGATGGAAGA CAGGATTGAA GGGGATATAG ATTGAAGGAA

38201 AGAAAGGTAG AAGGATGAAA TGAAGTAAAG ATTGAAGAAA AGATGGATGG

38251 AAAGAAGAAA GGAGGGTGCA CAAAAAATCT CACACTTCAC CACATATGAT

38301 TCATCCATAT AAGAAAAAAC CACTTGTACC CTCAAAGCTA TTGAAATACA

38351 AACTTTTAAA TTAAAATTTT AAAAGCAAG AGAAAGGAAA GAAGGGAGGA

38401 AAGACAAAAG GAAGAATGGG TGATAGAAGG AAAGAATAAA AGGAAGAAAA

38451 AATGGAAGAA TAGATGATCA GATCTAGGGA TGAATGAAAG GAAGGATGGA

38501 CAAATCTATA GGTAGGTGGA TGGATCTATG GACAGGTGTG GCCACTTATG

38551 GCACATAGTC CCAGCTCCAG TTCATACTGA TGGACTTGAG GAGTGTTTGT

38601 GGCCAATGAA GTGGATCCAT TTAGACAGTG CTCTTCTTCT GAATGAGATG
```

Exon 5
```
38651 AGTTACCCCA GTTTTCTCCC CCACCTTCAT CTTCAGGAAC TGATGGCATT

38701 ATGGAACACA TCACAAAAAT ACCCAATGAA GCAGCACACA GAGGTACCAT

38751 AAGACCAGTC AAAGGCCCTC AGACATCCAC TTCGCCTGCC AGTCCTAAAG

38801 GTAGGTTTAA CTTTGCTTAC CTCCCAGTAA TGCCACTCGT GACCATATTT

38851 CCTCCTCCAG AGAGACAAAA TGTTTGTATT CTTTAGAGAG AGAATTGTGT

38901 GTGGTTGTCA TAGGTTTCCC TGTCTGAACT GAGTCTTTAT CTAATGGTTA

38951 CCAGGCAGAT GTTACCACTG TCTCTTTCTC CTCATGGCAT GCTGAGTGAG

39001 TTTTGTCCAA CATCAAATAT TCACAAATTT GTCCATATTA ACCAAATTTT

39051 AAAATGCTC ATTAAAAACT TACTATGAGC TGGGCGCAGT GGCTCATGCC

39101 TGTAATCCCA ATACTTTGGG AGGCTGAGCT GGGTGGATCA CCAGAGGTCA
```

TABLE 27-continued

Genomic CA125 Amino Terminal Sequence
(SEQ ID NO: 311)

```
39151 AAAATTCGAG ACCAGTCTGA CCAAAATGGT GAAACTCCAT CTCTACTGAA
39201 AATATAAAAA TTAGCCGGGC ATGGTGGCAC ACACCGTAAT CACAGCTACT
39251 CAGGAGGCTG AGGCAAGAGA GTCACTTGAA CCACAGGAGG TAGAGGCTGC
39301 AGTGAGCTGA GCATTGTGCC AATGCACTCC AGCCTGGGTG GCAGAGCAAG
39351 ACTCCAGCTC AGAAATAAAT AATATATTAT ATATATATAT ATATGTTTTA
39401 TTTAGATGGA ATATACTATA TATATATGTA TATATATATG TATGTATATA
39451 TATATATGTA TGTATATATA TATATATATA TATATATATA TATATAGAGA
39501 GAGAGAGAGA GAGAGAGAGA GAGAGAGACA GAGTATGTCT GAGAATGCAT
39551 CCCGATAGTT CTAGCAAGGT AGGAAAAGGA AGTATCATAA CAGCCTTGAA
39601 GTAGCCTGTT GAAACAGACA GACTCTCTTG TAAGAGAACT CACAAAATCT
39651 AGGATTATAT CTCCCATGAT GAAAAATTTG GAACTGTACA TTTTTGTTTA
39701 ACTGTCACTT AAATNNNNNN NNNNNNNNNN NNNNNNNNNN NNNNNNNNNN
39751 NNNNNNNNNN NNNNNNNNNN NCCAGGAGGC ACTGTGCTTG GCGCCTTTTT
39801 ACCAACACTT TGAGATGGCC ATTGTACTTA TCCCCACTTT ATAGACGGGA
39851 AAATGGAGGT CCAGCAATAT TTTTTAACTT AAAGAGCCAC CCATCTCTTT
39901 AGAGAAAGAG CCAGAATCCC AGGCAGGGGC TATCTTATTC CAGAGCCCAA
39951 GCTCTCAAAC ACATGATACA CAATACTTAA TCTCTCTCAA GTCAGAGGAG
40001 ATCCACTTAA GTATACATCC ATCCACATAT TCATTCATTC AATCATTCAA
40051 CAAATATTAG TTGAGCACTT ACCGTATGCC AAACAGTCAA ACGTGAATAG
40101 CTGTTACAAA TGAGACTGTG AAGGATGGTA CAACGCAGAT TCAGACAGTG
40151 TGATAAGGAA ATATTGAGAA GCAAAGATGA GTTCTGGAGT GAATTTGTAA
40201 AGGTGGATGT GGGCTTGGAT TTCAATAATG GCAGAACTTA AGGAATCTGA
40251 TGAGAAGTGG GCACTTCAGG CAGAGAGAAG AGCTTGAACA AGGCTCAGAG
40301 GCTGACAGTG CAGGAAACAC ATGGGAAGAG GGAATAGAGT AGCGGTCAAG
40351 AATTCACAGA GGAGTTATAG GTGAAGATGC AACCAAGTTA CAGACCAAGG
40401 TAAGATAGGG GAATACCAAT CACAATCTCT TTTCCCATTC CAGAAGCATC
40451 CCAGACACAT CCTAGTAACC GAGAGACATT TCTCTCCCTT TCCTCCTGTG
40501 GAGAATAAAT AAGCTATTGC AAGTCCAGTA AGTGTAATCA TTTTGTTCAA
Exon 6
40551 ATTGTGTGCC CATTCCCCAA TTTACAGGAC TACACACAGG AGGGACAAAA
40601 AGAATGGAGA CCACAACCAC AGCTCTGAAG ACCACCACCA CAGCTCTGAA
40651 GACCACTTCC AGAGCCACCT TGACCACCAG TGTCTATACT CCCACTTTGG
40701 GAACACTGAC TCCCCTCAAT GCATCAATGC AAATGGCCAG CACAATCCCC
40751 ACAGAAATGA TGATCACAAC CCCATATGTT TTCCCTGATG TTCCAGAAAC
40801 GACATCCTCA TTGGCTACCA GCCTGGGAGC AGAAACCAGC ACAGCTCTTC
40851 CCAGGACAAC CCCATCTGTT TTCAATAGAG AATCAGAGAC CACAGCCTCA
40901 CTGGTCTCTC GTTCTGGGGC AGAGAGAAGT CCGGTTATTC AAACTCTAGA
40951 TGTTTCTTCT AGTGAGCCAG ATACAACAGC TTCATGGGTT ATCCATCCTG
41001 CAGAGACCAT CCCAACTGTT TCCAAGACAA CCCCCAATTT TTTCCACAGT
```

TABLE 27-continued

Genomic CA125 Amino Terminal Sequence
(SEQ ID NO: 311)

```
41051  GAATTAGACA CTGTATCTTC CACAGCCACC AGTCATGGGG CAGACGTCAG
41101  CTCAGCCATT CCAACAAATA TCTCACCTAG TGAACTAGAT GCACTGACCC
41151  CACTGGTCAC TATTTCGGGG ACAGATACTA GTACAACATT CCCAACACTG
41201  ACTAAGTCCC CACATGAAAC AGAGACAAGA ACCACATGGC TCACTCATCC
41251  TGCAGAGACC AGCTCAACTA TTCCCAGAAC AATCCCCAAT TTTTCTCATC
41301  ATGAATCAGA TGCCACACCT TCAATAGCCA CCAGTCCTGG GGCAGAAACC
41351  AGTTCAGCTA TTCCAATTAT GACTGTCTCA CCTGGTGCAG AAGATCTGGT
41401  GACCTCACAG GTCACTAGTT CTGGGACAGA CAGAAATATG ACTATTCCAA
41451  CTTTGACTCT TTCTCCTGGT GAACCAAAGA CGATAGCCTC ATTAGTCACC
41501  CATCCTGAAG CACAGACAAG TTCGGCCATT CCAACTTCAA CTATCTCGCC
41551  TGCTGTATCA CGGTTGGTGA CCTCAATGGT CACCAGTTTG GCGGCAAAGA
41601  CAAGTACAAC TAATCGAGCT CTGACAAACT CCCCTGGTGA ACCAGCTACA
41651  ACAGTTTCAT TGGTCACGCA TCCTGCACAG ACCAGCCCAA CAGTTCCCTG
41701  GACAACTTCC ATTTTTTTCC ATAGTAAATC AGACACCACA CCTTCAATGA
41751  CCACCAGTCA TGGGGCAGAA TCCAGTTCAG CTGTTCCAAC TCCAACTGTT
41801  TCAACTGAGG TACCAGGAGT AGTGACCCCT TTGGTCACCA GTTCTAGGGC
41851  AGTGATCAGT ACAACTATTC CAATTCTGAC TCTTTCTCCT GGTGAACCAG
41901  AGACCACACC TTCAATGGCC ACCAGTCATG GGGAAGAAGC CAGTTCTGCT
41951  ATTCCAACTC CAACTGTTTC ACCTGGGGTA CCAGGAGTGG TGACCTCTCT
42001  GGTCACTAGT TCTAGGGCAG TGACTAGTAC AACTATTCCA ATTCTGACTT
42051  TTTCTCTTGG TGAACCAGAG ACCACACCTT CAATGGCCAC CAGTCATGGG
42101  ACAGAAGCTG GCTCAGCTGT TCCAACTGTT TTACCTGAGG TACCAGGAAT
42151  GGTGACCTCT CTGGTTGCTA GTTCTAGGGC AGTAACCAGT ACAACTCTTC
42201  CAACTCTGAC TCTTTCTCCT GGTGAACCAG AGACCACACC TTCAATGGCC
42251  ACCAGTCATG GGGCAGAAGC CAGCTCAACT GTTCCAACTG TTTCACCTGA
42301  GGTACCAGGA GTGGTGACCT CTCTGGTCAC TAGTTCTAGT GGAGTAAACA
42351  GTACAAGTAT TCCAACTCTG ATTCTTTCTC CTGGTGAACT AGAAACCACA
42401  CCTTCAATGG CCACCAGTCA TGGGGCAGAA GCCAGCTCAG CTGTTCCAAC
42451  TCCAACTGTT TCACCTGGGG TATCAGGAGT GGTGACCCCT CTGGTCACTA
42501  GTTCCAGGGC AGTGACCAGT ACAACTATTC CAATTCTAAC TCTTTCTTCT
42551  AGTGAGCCAG AGACCACACC TTCAATGGCC ACCAGTCATG GGGTAGAAGC
42601  CAGCTCAGCT GTTCTAACTG TTTCACCTGA GGTACCAGGA ATGGTGACCT
42651  CTCTGGTCAC TAGTTCTAGA GCAGTAACCA GTACAACTAT TCCAACTCTG
42701  ACTATTTCTT CTGATGAACC AGAGACCACA ACTTCATTGG TCACCCATTC
42751  TGAGGCAAAG ATGATTTCAG CCATTCCAAC TTTAGCTGTC TCCCCTACTG
42801  TACAAGGGCT GGTGACTTCA CTGGTCACTA GTTCTGGGTC AGAGACCAGT
42851  GCGTTTTCAA ATCTAACTGT TGCCTCAAGT CAACCAGAGA CCATAGACTC
42901  ATGGGTCGCT CATCCTGGGA CAGAAGCAAG TTCTGTTGTT CCAACTTTGA
42951  CTGTCTCCAC TGGTGAGCCG TTTACAAATA TCTCATTGGT CACCCATCCT
```

TABLE 27-continued

Genomic CA125 Amino Terminal Sequence
(SEQ ID NO: 311)

```
43001  GCAGAGAGTA GCTCAACTCT TCCCAGGACA ACCTCAAGGT TTTCCCACAG
43051  TGAATTAGAC ACTATGCCTT CTACAGTCAC CAGTCCTGAG GCAGAATCCA
43101  GCTCAGCCAT TTCAACAACT ATTTCACCTG GTATACCAGG TGTGCTGACA
43151  TCACTGGTCA CTAGCTCTGG GAGAGACATC AGTGCAACTT TTCCAACAGT
43201  GCCTGAGTCC CCACATGAAT CAGAGGCAAC AGCCTCATGG GTTACTCATC
43251  CTGCAGTCAC CAGCACAACA GTTCCCAGGA CAACCCCTAA TTATTCTCAT
43301  AGTGAACCAG ACACCACACC ATCAATAGCC ACCAGTCCTG GGGCAGAAGC
43351  CACTTCAGAT TTTCCAACAA TAACTGTCTC ACCTGATGTA CCAGATATGG
43401  TAACCTCACA GGTCACTAGT TCTGGGACAG ACACCAGTAT AACTATTCCA
43451  ACTCTGACTC TTTCTTCTGG TGAGCCAGAG ACCACAACCT CATTTATCAC
43501  CTATTCTGAG ACACACACAA GTTCAGCCAT TCCAACTCTC CCTGTCTCCC
43551  CTGGTGCATC AAAGATGCTG ACCTCACTGG TCATCAGTTC TGGGACAGAC
43601  AGCACTACAA CTTTCCCAAC ACTGACGGAG ACCCCATATG AACCAGAGAC
43651  AACAGCCATA CAGCTCATTC ATCCTGCAGA GACCAACACA ATGGTTCCCA
43701  GGACAACTCC CAAGTTTTCC CATAGTAAGT CAGACACCAC ACTCCCAGTA
43751  GCCATCACCA GTCCTGGGCC AGAAGCCAGT TCAGCTGTTT CAACGACAAC
43801  TATCTCACCT GATATGTCAG ATCGGTGAC CTCACTGGTC CCTAGTTCTG
43851  GGACAGACAC CAGTACAACC TTCCCAACAT TGAGTGAGAC CCCATATGAA
43901  CCAGAGACTA CAGCCACGTG GCTCACTCAT CCTGCAGAAA CCAGCACAAC
43951  GGTTTCTGGG ACAATTCCCA ACTTTTCCCA TAGGGGATCA GACACTGCAC
44001  CCTCAATGGT CACCAGTCCT GGAGTAGACA CGAGGTCAGG TGTTCCAACT
44051  ACAACCATCC CACCCAGTAT ACCAGGGGTA GTGACCTCAC AGGTCACTAG
44101  TTCTGCAACA GACACTAGTA CAGCTATTCC AACTTTGACT CCTTCTCCTG
44151  GTGAACCAGA GACCACAGCC TCATCAGCTA CCCATCCTGG GACACAGACT
44201  GGCTTCACTG TTCCAATTCG GACTGTTCCC TCTAGTGAGC CAGATACAAT
44251  GGCTTCCTGG GTCACTCATC CTCCACAGAC CAGCACACCT GTTTCCAGAA
44301  CAACCTCCAG TTTTTCCCAT AGTAGTCCAG ATGCCACACC TGTAATGGCC
44351  ACCAGTCCTA GGACAGAAGC CAGTTCAGCT GTACTGACAA CAATCTCACC
44401  TGGTGCACCA GAGATGGTGA CTTCACAGAT CACTAGTTCT GGGGCAGCAA
44451  CCAGTACAAC TGTTCCAACT TTGACTCATT CTCCTGGTAT GCCAGAGACC
44501  ACAGCCTTAT TGAGCACCCA TCCCAGAACA GAGACAAGTA AAACATTTCC
44551  TGCTTCAACT GTGTTTCCTC AAGTATCAGA GACCACAGCC TCACTCACCA
44601  TTAGACCTGG TGCAGAGACT AGCACAGCTC TCCCAACTCA GACAACATCC
44651  TCTCTCTTCA CCCTACTTGT AACTGGAACC AGCAGAGTTG ATCTAAGTCC
44701  AACTGCTTCA CCTGGTGTTT CTGCAAAAAC AGCCCCACTT TCCACCCATC
44751  CAGGGACAGA AACCAGCACA ATGATTCCAA CTTCAACTCT TTCCCTTGGT
44801  TTACTAGAGA CTACAGGCTT ACTGGCCACC AGCTCTTCAG CAGAGACCAG
44851  CACGAGTACT CTAACTCTGA CTGTTTCCCC TGCTGTCTCT GGGCTTTCCA
```

TABLE 27-continued

Genomic CA125 Amino Terminal Sequence
(SEQ ID NO: 311)

| | |
|---|---|
| 44901 | <u>GTGCCTCTAT AACAACTGAT AAGCCCCAAA CTGTGACCTC CTGGAACACA</u> |
| 44951 | <u>GAAACCTCAC CATCTGTAAC TTCAGTTGGA CCCCCAGAAT TTTCCAGGAC</u> |
| 45001 | <u>TGTCACAGGC ACCACTATGA CCTTGATACC ATCAGAGATG CCAACACCAC</u> |
| 45051 | <u>CTAAAACCAG TCATGGAGAA GGAGTGAGTC CAACCACTAT CTTGAGAACT</u> |
| 45101 | <u>ACAATGGTTG AAGCCACTAA TTTAGCTACC ACAGGTTCCA GTCCCACTGT</u> |
| 45151 | <u>GGCCAAGACA CAACCACCT TCAATACACT GGCTGGAAGC CTCTTTACTC</u> |
| 45201 | <u>CTCTGACCAC ACCTGGGATG TCCACCTTGG CCTCTGAGAG TGTGACCTCA</u> |
| 45251 | <u>AGAACAA</u>GTA AGAATAACTT TTTTATTGTG GTAAAATATA AATACTATAA |
| 45301 | AAATTGCCAT TCTAAACATT TTAATTGTAC AACTCAGCAG TACTAATACA |
| 45351 | TTCACATTGT TGTGCAACCC TCACCACTAT CTGTTTTCAA AACTTTTTTT |
| 45401 | ATCACCCCAA ACAGGACTGA AGGAATAATT TCCCATTCCC CATTCTCCCT |
| 45451 | AGTGCAGTGG TGCAATCTCG GCTCACCACA ACCTCTGAAC CTCTGTCTCC |
| 45501 | TGGGTTCAAG CAATTCTCCT GCATCAGCCT CCTGAGTAGT TGGGACTACA |
| 45551 | GGTGCACGCC ACCGTGCCTG GCTAATTTTT GTATTTTTAG TACAGACAGG |
| 45601 | GTTTTACCAT GTTGGTCAGG CTGGTCTCAA ACTCCTGACC TCAGGTGGTC |
| 45651 | CACACGCCTT GGCCTCCCAA AGTGCTGGGA TTACAAGTGT GAGACACTGT |
| 45701 | GCCCGGCCAT ATCTGTTAGA TCTTACTAAT CCTGTCAAGA GGATTCAGTG |
| 45751 | TCCTTTTTTT TTTTCTTTC TTTTTTTTGA TAGAGTCTCC CTCTGGCACC |
| 45801 | CAGGCTGGAG TGCAGTGGTA CGGTCTTGGC TCACTGCAGC CTCCACCTCC |
| 45851 | CAGACTGAAG CGATTCTCCT GCCTCAGCCT CCCGAATAGC TGGGACTACA |
| 45901 | GGCGCGTGCC ACCACGCCCA GCTAATTTTT GCATTTTTAG TAGAGATGGG |
| 45951 | ATTTCACTAT GTTGGCCAGG CTGGTCTCAA ACTCCTGATC TCAAGTGATC |
| 46001 | CGCCCAAGGG CCTCCCAAAG TACTGGGATT ACAGGTAGGA GCCACCTCAC |
| 46051 | CTGGCCCTAT TTTCGGAATG GATTTTTTTT TAATGTTTAA AATGTCACCT |
| 46101 | AAGATTATTG TGAAGATCAA ATAAGATAAA ATCCTAATAA CCCAAGTAAA |
| 46151 | CCACAGGGCT CCACTTGGAC CAGTCTCAGA AGTTTCAAGA AAATCAGTCA |
| 46201 | GACCATCAAA TGTAAAATAA GTCTAAATTT TCTTTGCACT ATTCACAGAG |
| 46251 | TGCCAAAGAG GATCTAATTC ATGTTTCAGA ACATACCCTA CTTACTAAAA |
| 46301 | TCCCCTTTTC CTCATTTCTT CTCATTCTGC AACTTTATCA TCTCCTGCGG |
| 46351 | ACCCCCTAGC CTCTCCCCTC CCCATAGTCA GTCTCTCTCT CTCTCTTTCC |
| 46401 | CTCCCCTCTT ATTATCTCAA TTTCACACGA AAGAATTCCA GAAACTATAC |
| 46451 | TGCCAAAAGT CTTTCCTGTC TTTGAAAAGT TGGGAAAGAG GAGAAACTCA |
| 46501 | GACAGCAATG ACAAAATTAT ACGTAATGGA TGAAGGAAAC ACAAATAAGG |
| 46551 | CTGGAAACAG AAAATTTTGT CCCCATCATT TATTTAATGA AGGTGGCAGT |
| 46601 | ATTCCAGCCA CATAGTGAAC CCCCACAATA AGAAGGGGCC TCTGGCGATT |
| 46651 | GATTATTGTC ATTGTTGTTA ATGATAATGA GGGTGAGGAT ATCATGAGCA |
| 46701 | TCAGTGTAGG AGGCAGTTAA CTAATAAGAC CAAGCTGTTG GCTGGGCGTG |
| 46751 | CTGGTTCACA CCTGCAGTCC CAGCACTTTG GGAGGCCAAA GTGGGTGGAT |
| 46801 | CACTTGAGGT CAGGAGTTCA AGACTAGCCT GGCCAACATG GTGAAACCTG |

TABLE 27-continued

Genomic CA125 Amino Terminal Sequence
(SEQ ID NO: 311)

```
46851  GTCTCTACCA AAAATACAAA AATTAGTCAG GTGTGGTGGC GTGTGCCTGT

46901  AATGACAACT ACTTGGGAGG CTGAGGCAGG AGAATCACTT GAACCTGGGA

46951  GGCGGAGGCT GCAGTGAGAT GAGCTTGAAC CACTGCACTC CAGCCCGGGC

47001  AACAGAGAGA GACTCTTGTC TCAAAAAACA AAACAAACAA ACAAAAACTA

47051  AACCAAACAA AAAAGACTA GCTGTTATTC ATTTATTTAT TTATTTATTT

47101  AGAGACGGAG TCTCGCTCTG TCACCCAGGC TGGAGTGCAG CGGCACAATC

47151  TTGGCTCACT GCAACCTCTG CCTCCCAGGT TCATGTGATT CTCCCGCCTC

47201  AGCCTCCCCA GCTGTTGTTA TTCATGAATG AACCTCAGAG AAAGCACACA

47251  GGAGGGTTGG TGCACCTGTG TTTTGAGTTC TACCCCTCCT TCCTCTCTTA

47301  ACTTCCTCCT GTCTTCTCAC TCTGATTCGT TCTTCCTTCC TCTCCCTCTC
```

Exon 7
```
47351  TCTCTGCAGG TTATAACCAT CGGTCCTGGA TCTCCACCAC CAGCAGTGAG

47401  TAAACATGGC CCTGAAGTCC CTATGCCCTG GGAATTCTTC CTCCCTAAGC

47451  CTGCCTTCCA GGAGGAAAGT ATCCCCCATT CCCTAGGTTC TCATCCCCAC

47501  AGAAACTCCA GAATAGCAAA AGTCTCAGGC TGAGCCAAGG CACAGATGCC

47551  AGTGCTCACC AAGAGTCCTA TTCTCCCCTC GCTAAATGAT AGGACCCAAC

47601  AAACCCGATT CACGCTGCGT TTTCTTTCAG CTCCGATGAC CTCCATGTTC

47651  TCTCCAAGGC CTCTCGTATC TGTGAGCCCC ACCCCAGCG CTACAGGTAG

47701  GAATCTGGCT TCCAGCTCCC ATGAAACGTC GGCTGCCATT CAGTGGCTGA

47751  TTAATTGCTG TGTGGTCTGA GTCCTGATGC CCACCAAGTC TCAGCGTGTT

47801  CCCCTCTGTC CAATCTCATC CAACAATTTA AGCTAATGCT TGTTTAATGA

47851  TGTCCTCACT ATACCACCTT GGACACTTTC TTTTTGCCTG GATTTAAAGC

47901  TTCCATTTCT TTCCTTCCTT CCTTCTTTTC TTCCTTCCTT CCTTCCTTCC

47951  TTCCTTCCTT CCTTCCTTCC TTCCTTCCTT CCTTCCTTCC TCCTTCCTTC

48001  CTTCCTTTCT TCCTTTCTTC CTGTCTTTTT CTTTCTTTCC TTCTTTTGGC

48051  AGAGTCTCAC TCTGTCGCCC AGGCTGGAGT GCAATGGTGC AATCTCGGTT

48101  CACTGCAACC TCTGCCTCCC AGGTTCAAGC GATTCTCATG CCACATGCCA

48151  CTATGCCTGG CTAATTTTTG TTTTTTTGTT TTTTGGGGG TTTTTTGAGA

48201  CAGAGTCTCA GTCTGTTGCC CAAGCTGGAG TGCAGTGGCA TGATCTCGGG

48251  TCACTGCAAC CTCCTTCTCC CAGGTTCAAG CGATTTTCCT GCCTCAGCCT

48301  CCTGAGTAGC TGGAACTACA GGCACGCACC ATCACACCGG CTAATTTTTT

48351  GTGTTTTTAG TAGAGACGAC GGTTTTGCAA TGTGGGCCAG GCTTGTCTCG

48401  AACTCCTGAC CTCAAGTGAT CCTCCAGCCT CGGCCTCTCA AGTGCTGGG

48451  ATTACAAGTG TGAGCCACTG CACCAGGCCA AAACTTGTA TTTCAATAGT

48501  CATTGAGGCT GGGTGCAGTG GCTCACGCCT GTAATCCCAG CACTTTGGGA

48551  GGCTGAGGCC AGTGGATCAT GAGGTCAGGA GATCAAGACC ACCCTGGCTA

48601  ACACAGTGAA ACCCCATCTC TACTAAAAAT ACACACAAAA ATTAGCCGGG

48651  CATGGTGGCA AGATGCCTGT AGTCCCAGCT ACTCAGGAGG CTGAGGCAGG

48701  AGAATGGCGT GAACCTGGGA GGCAGAGCTT GCAGTGAGCG GAGATCGCAC
```

TABLE 27-continued

Genomic CA125 Amino Terminal Sequence
(SEQ ID NO: 311)

```
48751  CGCTGCACTC CAGCCTGGGC AACAGAGAGC GACTCTGTCT CAAAAAAAAA
48801  AATATATATA TATATATATA TATATTCATT GAGACCGACT CTGACTTAAA
48851  AGCAGTAATG AATGGTGTAG GTTTTGGTAA ATTACAGGTC TTGCTTTAAG
48901  TCCTGGTCCT CTCTTTTGCT CACTGTGTGG CCCCGGAAGA GCCATGTAAC
48951  CTCTCCAGGC TTCAGTGTCC ATTTTTAGAA CGGAGTAAGT GAATAAGCTG
49001  TGTCCAATCA TCTCTGGCCA TATCAGCTTC ATTTTTTTTT TCCTCCAGGG
49051  TCCAAACATC CCTCCACCCT CAGAGTCTTT GCACCTGGTG TTCTTGTCCT
49101  TCAAATCTCA GCTTGGATCA CCCTTTATAA AGTAGCATTT CCCCCGTATA
49151  CGCATCTTGC ACACAGCCAA TCTCTATTCT ACCTCTATGC TCACTTCCTT
49201  CCTGGCAATT ATTACTACAG CTGGGCCCTT GAACAGCATG AGGGTTCAGG
49251  GTGCTGACCC CTATGCATTC AAAATCCAC ATATAACTTT TTTTTTTTG
49301  AGATGGAGTT TCACACTTGT TGCCCAGGCT GGAGTGCAGT GGCGCCATCT
49351  TGGCTCACTG CAAACTCTGC CTCCTGGGTT CAAGTGATTC TCCTGCCTCA
49401  GCCTCCTGAG TAGCTGGGAT TACAGGCATG TGCCACCATG CCCAGCTAAT
49451  TTTGTATTTT TAGTAGAGAT GAGGTTTCTC CATGTTCGCC AGGCTGCTCT
49501  TGAACTCCTG ACTTCAGGTG ATCCGCCTGC CTTGGCCTCC CAAAGTGCTG
49551  GGATTACAGG CATGAGCCAT GATGCCCGGC CATTTGCTAA TGGCATCTAG
49601  TAAGTAGAGG CCAGAGATGT TGCAAAACAT CCAACAATGC ACAAAGCAGC
49651  CTCCTATCAA AACACATTAT CCAGACCAAA ATGTCAATAG GGCTGAGGTT
49701  GAGCATCTGC TGTACACAGA TTCCAAGTTC TGGTACAAAT CTCGTAGTTC
49751  TCTGAGGGCT CATCTTTCAA TGCCTAGCAC ATCAAAGGAG GCCAATTTCC
49801  TCTTCCCTTT CACCTCCTGG TATGAAATGT TTCCTCCTCC ACCTTGATCC
49851  TGTAAGAGCC CAGCTGGAGT TTGCAGACGA CGGGGAAAGA AATGGGTGAG
49901  GGAGGGTCCT ATGGTTGAGT CTCCGCAGTG GGCCCTGGGT GCCCAGTTCA
49951  CCCTCCTCCC CTTCATTTTC TCCATCATGA CAACTCAAGG CAAATTCTCA
50001  GTTTCCATGG GCCAGTGGAA TCCACTGACT TCATGAAATA ACCCCACCCT
50051  GAGCAAATAC CCCTCAAATA ATAACTGTTT ACACAACATC AGTGGCAACA
50101  ATGACCCAAG CAGCAATGCC ACCACCAGAA TAGCAACCAT AACAGCAGCT
50151  CATTTTCATC AAAAGGAAAC TGTAGGGCCA GGCACAGTGG CTCACACCTA
50201  TATTCCCAGC ATTTTGGGAG GCTGAGGCAG GCAGATCACC TGAGGTCAGG
50251  AGTTCAAGAC CAGCCCAGCC AACATGGTGA AACCCCATCT CTACTAAAAA
50301  TACAAAAACT AGCCAGGCTT GGTGGCATGT GCCTGTAATC CTAGCTACTC
50351  GGGAGGCTGA GGCAGGAGAA TTGCTTGAAC CTGGGAGGCA GAGGTTGCAG
50401  TGAGCTGAGA TTGTGCCACT GCACTCCAGC CTGGGCGACA GAGCAAGACT
50451  CCGTCTGAAA AAAAAAAAAA AAGGAATTGT GCCAGGAATT GTGATGAGAA
50501  CTTTATATGC ATTATCTCCT ATTAATATTA CCCAAACCTC CGTGAGTTAC
50551  TATACTCATT TCTACAGAGA GCATTTATGC ATCCAGGGAG GAAGTAATTA
50601  GCCCAGAATT ACTCAGTTAT GACACAGGAC AGTATGAAAA CTCCAACCGA
```

TABLE 27-continued

Genomic CA125 Amino Terminal Sequence
(SEQ ID NO: 311)

```
50651 AGATTGGAGA CTCATGAAAA CTCCAGGCTC CTAACTACAA GACATCACTG

50701 TGGATCGTCC AAATAGAGCA AGCCCCAATC TCAGGACAGG AATGAGGCAT

50751 GAATGGCCTC TATGCTAATG ATCTAACCTA ATGCTGAATT TGTTACTTCC

50801 CTTCTGAATC CACTTGGAGA TTTCCTTTAT ATCTGACTTG AAATAGAGGA

50851 TATATACTCC TCTATCCTTG ACATAGGAGA TAATACACAG AAAGTATTTC

50901 ATTGTAGTAT CAAGTACACA TCCTGTTCTG TGTCCATAGG ATTATGACTA

50951 ATTTAGGGCA TGGCTTAACA GTGTGGTACT ATTGAATGAC AGACAGATGT

51001 CTGTTTTGTT GGATGCAGGA CAAGCCATGT AACCTCCCCA GACTTTAGTG

51051 TCCCCTCTGT GGAATGGAAT AAAAATACTA CGTGGGATTG TTCTGATAAT

51101 CAAATGAGAT AATTCAGGAA CAACCCAGAT AAATAACAGG GCTGCCCTGG

51151 GTTCTGTCTT TCCTTGTATC TCTCACAGAG CCTCAAAGGA GATGCAATCC

51201 ATGACCTAGA GAAACACTCA GGACAAATTC TCTTTTCCCC AGTTCCTTTC

51251 TTGCTCCAAT GGCAACACCA CCCCTCTCAT CCTGAAGTCT CTTGTTTTTA

51301 CCACCACACC TATTTTGCCA AATTTTCTCC AATATTCCAA ACCATATGAA

51351 ACCTTTCTTT CTTTCTTTTC TTTCCTTCCT TTCCTTCTTT CTTTCTTTTT

51401 TCTCTTCTTT TCTTTTCTTT TTGAGACATG GTCTCACTCT GTTGCACAGG

51451 CTGGAGTGCA ATGGCACGAT CTTTGCTCAC TGCAACCTCC GCCTCCCAGG

51501 TTCAAGAGAT TCTCTTGCCT CAGCCTCCTG AGTAGCTGGG ATTACAGGCG

51551 CCCACCGCCA CGCCACGCTA ATTTTGTGT TCTTAGTGGA GACGGGGTTT

51601 CGCCATGTTG GCCAGGCTGG TCTTGAACTC CTGACCTCAA GTGATTTGCC

51651 CATCTCGGTC TCCCAAAGTG CTAGGATTAC AGGCGTGAGC CACCAAGCCC

51701 GGCCCCATAT GAACCGTTTC TATCCCTCAT TTCTCTGTAC TTTTACCTAA

51751 AAACACCACT CCCTTCACCC ATCACATTTT TGTCAATTCT ACATCACACA

51801 CACACACACA CACACACACA CACACACAGA GAAAGTAAGT TGGAAAAAAA

51851 TTATACTATC ATGAAATTTT GTGAAAGGAG GTAAGCTGAG AGAGTAAGAA

51901 TCAAACTAAA TTATCTTTAT GGGTAGAAAG CACACTCATC CATACATGTG

51951 TCTTTCCACC CTTGTAATGT ATTTATTATT ATTGTTTGTA TATACTAGAT

52001 TCCCAATAAA TAGGGACAGC TATTATGGTA TTTTTATTTC AGGAATAATA

52051 ATAGTGATGA TTTCCACCAT TATTGTCAAA GGACAAAGCA CAAAATATGT

52101 ACCAAATAAA ATATAGCCAT TATCCTTTAT TCACAAAAGA TCTTGGCCCC

52151 ACCTCTTCTC AATGAAATGT CCATGACTTG TTCAACTTTG GCCACTCTGG

52201 GCTGAGAGAT GGAGGTTCCC TTGCGAGCTG AAGTCACACA TCGAAGGTGG

52251 AAGCCCCTCC CCTCCCTCTG GCTGGCTGAG GGATAGCCCA GATGGGCTCA

52301 TCATGAAAGT TTCCCATTAT TTCCATTTCT GGATCTACCA TCTTCCCCTC

52351 CCCTACCTCT CACCCATCAT AATTGTCCTT CTTTACTCTT TCCTCCCTAT
```

Exon 8
```
52401 CTGCAGGTTA TAACCGTCGG TACTGGACCC CTGCCACCAG CAGTGAGTAT

52451 TCAAACCTGT GATATTCCAA TGCCCTTGGG ACCCTTCCTC CCCAAGGTGC

52501 ATTCCTCAGA AGAGAAACTG ATCATTCTCC CTCCCTACGT GCCCAGCCAC
```

TABLE 27-continued

Genomic CA125 Amino Terminal Sequence
(SEQ ID NO: 311)

```
52551 AGCCTCAGAG CAGCCCCTAA CCCGTCAAGG TCTTGGTGTG AGTCAAGATA

52601 GAAGTCCAAA TTCCAATGAG CAGTTCCTGT CCCATATTCC TTTAGGAAGA

Exon 9
52651 CACCCAATCA TTTCTCCATG TTCTTTTTTT CTCAGCTCCA GTGACTTCTA

52701 CATTCTCCCC AGGGATTTCC ACATCCTCCA TCCCCAGCTC CACAGGTAGG

52751 AAGCTCCTCT CTGGCATCTA TGAAATTTAA CACTGCATGG TCTGTTCCCT

52801 GCTGACCACC CAGACTCAGC CTGTTCCACT CGCCCTCTCA CTCTCTCTCT

52851 CTCTCTTTTT TTTTTTTTTT TTTTTTTTTT TTTACGGAGT CTTGCTCTGT

52901 CACCCAGGCT GGAGTGGAAT GGTGTGATCT CGGCTCACTG CAACCTTCGC

52951 CTCCCAGGTT CACGTGATTC TCCTGCCTCA GCCTCCGGAG TAGCTGGGAT

53001 TACAGGTGCA CACCACCATG CCTGGCTAAT TTTTTGTATT TTTAGTAGAG

53051 ACGGGGTTTC ACCATGTTGG CCAGGCTGGT CTTGAACTCC TGACCTCAAG

53101 TGATCTACCC ACCTTGGCCT CCCAAAGTGC TGGGATTATA GGCATGAGCC

53151 ACCACGCCAG GCCCACTCTC TAAATTTTGA CCACCCTGCC TTGAGTGGTC

53201 TTCTAGCACC CTAACCTCTG TCTAACCTCG AGAGCTTTGC ACTAGCGATT

53251 CCTGGGGACC AGCTATGGTT GGTATCTTCT CAACTTTCTA ATTTTTTTAA

53301 AATTATTATT ATTATTATTA TTATTTTAAA TGGAGTCTCG CTCTGTCACC

53351 CAGGCTGGAG TGCAGTGGCA CCATCTCGGC TCATTGCAAC CTCTACCTCC

53401 CGGGTTCATG CAATTTTCCT GCCTCAGCCA GAAATTTTCT CAGTGGTCGA

53451 GATTGTGCCA CTGCACTCCA GCCTGGGCAA TGGAGCTAGG CTCCATCTCA

53501 AAAAAAAAAA AAAAAGACG GAGGTCGGGC ATTCCTAACC CTTAACCCTG

53551 CCTTGTGATT CTGGAGTTAT GAGATAGAAC CTGGTGTCCC GTAATTAAAA

53601 TTCCGCCTTC AGGCCTTATG TTTTGTGAGT CACAACACTG CAAACTTTTT

53651 ACATGCTGTA GACAGGATGT TCACTCTCCA CTTCCTCACT GCTCTGCTCT

53701 AATCAATTCA ACCATTTATG TGACATGCCT AACCCCTCTG GGCTTGTACG

53751 TATGTAACAT GTATTACAAA GCAAGTCATT CCATGATCAA TGCTGTCACT

53801 TTTTCTAGGT GCTTTCAAAA TTTGTTCTTC ATCATTGATT TTCAGTAGTT

53851 TGATTACGAT GTGTCTGGGC ATGGTTTTCT TTGAGTTTAT CCTGCTTAAA

53901 GTGTTCTCAG CTTCTTGAGT CTCAAAGTGT TTATTTTCTG CTCTGATTCT

53951 TTCTCCCCTT CGGACCTCCA ATGAAATGAT GTTGCCCGAA GAGACCCTGA

54001 GGTTCTGTTC ATTTTGTTAT TTATCAATCT TTTTTCCTCT CCGAATTTCA

54051 GGTTTAATAA TTTTTTTTTT TTTTTGAGA CGGAGTCTCG CTCTGTCGCC

54101 CAGGCTGGAG TGCAGTGGCG CGATCTCGGC TCACCGCAAG CTCCGCCCCC

54151 TGGGTTCACG CCATTCTCCT GCCTCAGCCT CCGGAGTAGC TGGGATTACA

54201 GGCACCCGCC ACCATGCCCG GCTAATTTTT TGTATTTTTT AGTAGAGACG

54251 GGGTTTCACC GTATTAGCCA GGATGGTCTC AATCTCCTGA CCTCGTGATC

54301 CGCCCGCCTC AGCCTCCTAA AGAGCTGGGA TTACAGGCGT GAGCCACTGC

54351 GCCCGGCCCA GGTTTAATAA TTTTTATAGA ATATTTTCAC AATCACCAAG

54401 CCTTTTCTCT ACCAGCTCCA TTCTGCCCAT CCATTGAATT CTTTTTATCT
```

TABLE 27-continued

Genomic CA125 Amino Terminal Sequence
(SEQ ID NO: 311)

| | | | | |
|---|---|---|---|---|
| 54451 | CAGTTACTTT | ATGTTTCAGT | TCGAAAGTTT | CTACTTGGTT | AGATAGATAG |
| 54501 | ATGTTATATC | ATATATTATA | TGTTATATAA | AAATATATTT | ATGGTTATAC |
| 54551 | ATATAACATA | TATGTTATAT | ATAGTTATTT | ATATAGCCAT | AACTATATAT |
| 54601 | AGCCATATAT | ATAGTTATAT | ATAACCATAT | ATATAGTTAC | CATATAGTAA |
| 54651 | CCACATATAT | AAAACATATA | TATATAGTGT | CTCTCTATAT | ATAGTTATAT |
| 54701 | ATATAGTTTC | TATATCTGTA | ACTATATATA | GTTATATATG | TATGTTTCTC |
| 54751 | TGTATATAAA | TATATATATT | TCTATATATA | TAGTTATACA | CATTATATAT |
| 54801 | ATAACTGGGA | GATGTTGGTA | AAGGATGGCG | TGAGGAAACC | TGGAGCAGTC |
| 54851 | ATGGTAATCC | TCGCTCTGCT | CCGAACTCCT | CAAGAGCAGG | AGAAGGGTCC |
| 54901 | TCCTCATTCT | CCAGCCATGT | TGACTTTGAG | CAATTTACTC | ATCCTCTCAG |
| 54951 | TACCTCAGTT | TCCTCACCTG | CCAATTGAGG | ATAATAATAT | TTCATAAATT |
| 55001 | GTTTGCAAAT | GTTATATGCA | ACTCTACGTA | AGAACACCTA | GCACAGGGGC |
| 55051 | TACCAGGGAA | TTTGGTTTAA | CAAATATTTA | TCAGGCACCT | ATTCTGGGCT |
| 55101 | GGGCAGGGGG | GATAAGATGT | TGACTAAGTC | AAATGCAGTC | CCTCCCCTCA |
| 55151 | CCAAGTTTAC | AGTGTATTGG | GCAAGACTGA | AATGGAACAA | GCAATTACAA |
| 55201 | TTGACAATAA | AAGACAACCA | AGTTATTGAG | CACTTACTAT | ATGGCATGCC |
| 55251 | ATATGCTATG | TATTTTTTTT | ATTTTTAACT | TTTCATTTTG | AAATAAATAA |
| 55301 | TAAATATAAA | GTAAATAATA | ATATAAATAA | ATAATAAATA | ACTTTTCATT |
| 55351 | TTGAAATAAA | TAATAAATAA | ATTCAGGAGA | TGTTGCGAAA | ATAGTGTAGC |
| 55401 | ATTCCCCTGT | ATCCTTCACC | CAGTTTCTCC | CCAATGGCTA | CATCTTACAT |
| 55451 | AACTCTAATA | CAATATCAAA | AGCAGGAAAC | TGACATTGTT | AAAATCCATT |
| 55501 | TTACTGGTTT | TACACGCGTG | TGTGCATATG | TGAGCTTGTG | TATGTGCGTG |
| 55551 | TGTGTGCAGG | CATGTGTGTG | CATGCACGCC | TGTGTGTGCA | TATGTGCATG |
| 55601 | TGTGCATGCG | TGTGTGCATG | TGTGCATGTG | TGTGTGCATG | CGTGCGTGCG |
| 55651 | TGCGTGCATC | TGTGTGCATG | TATGCACATG | TGTGTGTGTC | TGTGCACGTG |
| 55701 | TGTGCATGCA | TGTGTGTGTG | CGTGTGTGTT | GGTAGCCCTA | TGCAATTTTT |
| 55751 | ATCACATGGG | CATAGCCCTA | TAATCACCAC | CACCATCAAG | ATTCAGAACT |
| 55801 | GTTCCATTCC | CCCAAAGATT | CCCCTCATGC | TAGCCTTCGT | AATCATGCCC |
| 55851 | ACTGAGCCCA | ACACTATTGC | ATAGAATAGC | TATTCTACTC | TCCATCTCCA |
| 55901 | TCTCTGTCTC | TACAATTTTC | TTTTGAAGAT | GTTATATAAA | TGGAAATGTA |
| 55951 | CAACATGTCA | CCTTTGAAAT | TGGCTTCTTT | TCCACTCAGT | GTAATGCCCT |
| 56001 | GGAGATGTGC | TCTTTTTAAC | AGTCATGTAA | CCTTCCTAAT | TTCCCTCCAA |
| 56051 | AATATCATTA | TGCCCCTCGC | CGCCTTTTTT | TTTTTTTTT | TTTTTGAGA |
| 56101 | CAGAGTCTCG | CTCTGTTGCC | CAGGCTGGAG | TGCAGTGGTA | TAATCTCAGC |
| 56151 | TCACTGCAGC | CTCCGTCTCC | CGGGTTCAAG | GGATTCCCCT | GCCTCAGCCT |
| 56201 | CCCAAGTAGC | CAGGATTACA | AGTGCATGCC | ACCACGCCTG | GCTAATTTTT |
| 56251 | GTATTTTTAG | TCGAGACGGG | GTTTCATTGT | GTTGGCCAGG | CTGGTCTCGA |
| 56301 | ATTCCTGACC | TCAAGTGATC | TGCCCGCCTT | GGCCTCCCAA | AGTGCTGGGA |
| 56351 | TTACAGGTGT | GAGCCACCGC | GCCCGACCCA | TATTGCCCAT | TGTATTACAG |

TABLE 27-continued

Genomic CA125 Amino Terminal Sequence
(SEQ ID NO: 311)

| | |
|---|---|
| 56401 | CGGAAGAAAC TGAGGTATGG ACAGGTAACA TGTCCATGGT CACTTGGCTG |
| 56451 | GTGAGGGGCA GAGAGGAGAT TTGAAACCAA ATCTGACTCA CTAGTGTGGC |
| 56501 | CGTAACCATG GTAACTATGT CTCTCTACCA TGTGGTCTCC TCTTTATTAA |
| 56551 | AGGAAGGGCA AGTTCTGGGA GTTTTGGGAG TTTTGGGCTT GAGTGGGGAA |
| 56601 | GGGTAGCCAA GTAAAGCAGG TGAGAGAAGG TCTGCTTTAA GGACTGCTGT |
| 56651 | TTGATTTTTA TTGTTGTTGT TCAGTGTTCA ATGGGATTGA GTTGACTCTT |
| 56701 | TTTTCCCTTC TTGTTCCCCA AAGCATGAGA CTGTTCCGGT CCTTTTCCCT |
| 56751 | TTTAACTTCT CAGCTAGAGT TTGTTAGGGC GGGTATGGGC ACCTGGCAGA |
| 56801 | GTCTGAGACC TCAGCTTCCA GTAGGCACAC GTTCTGACCC AATACACCTA |
| 56851 | CCCTGGTCCC CTAACCTGCT TCTGGTCCCC TAACCTGCTT CTGGGCCCAG |
| 56901 | GTAATGCATT TTAGGAACAT CCCACTTTTC TCCTTACCTG GCTTTCCATT |
| 56951 | ATCCGTCCAA ACTAAAGCAC CCACCTGTCT GCTTCAGACT CTTGCTTCAA |
| 57001 | GCACTCCGTC TGGGTCCTCA GAAATTGACT TACAGTCAGT TCAGATCTGA |
| 57051 | CTCAGGCGTG GCCTTCTTTT CTCCTTCCTT GC |

TABLE 28

Genomic Repeats
(SEQ ID NO: 312)

| ExonR1 | |
|---|---|
| 1 | <u>AGCAGCCACA GTCCCATTCA TGGTGCCATT CACCCTCAAC TTCACCATCA</u> |
| 51 | <u>CCAACCTGCA GTACGAGGAG GACATGCGGC ACCCTGGTTC CAGGAAGTTC</u> |
| 101 | <u>AACGCCACAG AGAGAGAACT GCAGGGTCTG</u> GTGAGAGCCC CGCCCACCGT |
| 151 | ACTCCTCCCT CGCCCACTTA GACAAACCAG CCCACCTCAC ACTGCCTCGC |
| 201 | CCACTGATGC CAGCCACGCC CACCTCATCC AACCCCAGAC ACCTTTCCCT |
| 251 | GCCCCACCCA CTGATTTTAG CCAAGCCCAC CTCACCCCAC CCAGCCTACT |
| 301 | GATGCCAGCC ACGCCCACCT TTCCCTGCCC CGCCCACTGA TTTCAGCCAC |
| 351 | GCCCACCTCA CCCTGGTCCA CCCCTCCAAT GCCCCACTCT TCCTGGCTTC |

| Exon R2 | |
|---|---|
| 401 | CCGCAGCTGT TGTTTCTCAC CTCCCCTCTC CTTCCTTGCA <u>GCTCAAACCC</u> |
| 451 | <u>TTGTTCAGGA ATAGCAGTCT GGAATACCTC TATTCAGGCT GCAGACTAGC</u> |
| 501 | <u>CTCACTCAGG</u> TGAGACGCTC CTTAAGAAAA ACACAGCCCA ACAGGTGAAT |
| 551 | ATGACCCTAG TCTCTGGGCT CCCTGACTCT GTTCATACTT GGAACAACTA |
| 601 | TTGCCCATGG ATACTAAGCA TCACCACCAG CAGCAGCAGA TAACTATTCC |
| 651 | TAAGACCCAA GGCACTGCAT TATGTACTTT ATATTTAATG CCTCATCAGT |
| 701 | GCTTGCAACA GCCTCATGAA GCAGGAGCAG AAGGGGAAAC TGAGGCCCAG |
| 751 | ATTAAGTGGC TTGTGCCAGG ACACACAAAG CAACTGCAGC ACTTCAGGTT |
| 801 | CTATATCCAA ACTCCTATCC CTTAGGTGGC ACTTCCTCCT CTGCCCCCAT |
| 851 | TATGAACTTG CAGCATGTGG AAAACCCCAA TCTGACTTCC CTCTAAGGGA |

TABLE 28-continued

Genomic Repeats
(SEQ ID NO: 312)

| | |
|---|---|
| 901 | ACTTGCCCAG AGAATCTAAG AGGGGAGGAA AGGAAGGCGT TCAGCCCTTA |
| 951 | CAGGCAGGAG GTCAGCTCCT GAGTGGCTCA GATGCAGCCA CAGAGGGCCT |
| 1001 | GGCCGGTCTG AGGGTGACTG AGAGGCACCG AGGGCACTGT CCCTGAGTGC |
| 1051 | TGGAAAGGGC AGGTCTTTTA GGGTAGACAG CGGTTGATAT CATTTCCTGC |
| 1101 | CTGGCATTCT CACCTTCCAC ACCTCTCTCA CAGAATCTCC AAGTGTGGCT |
| 1151 | CTCCCAAGAG AGAGTGTCAG TCATCTACCT CCAGCTTCCT TTCCTTCCCA |
| 1201 | GGGGGAAGAG GGGACAGGGG GGCCCTAGTG GCTAAGAGCA TTGGTGAACT |
| 1251 | CAGGCAGACC TCAGTTCTGA ACCAACCCAG CTCTGCCATT TACTATCTGT |
| 1301 | GACTCTGAGC AAGTGCCTGA AGCCTTCTGT GCCCTATTTC CTGACATATT |
| 1351 | ATATATATAA AATACATATA TTATATATAG ACATATTTTA TATACATATT |
| 1401 | GAGGCATATT TTATAAACAT GTTTATAGAC ACATTTTTAT ATGCATATGT |
| 1451 | TATATACGTA TATAACATAT GTTATATATA ATGTATATAT TATACATATT |
| 1501 | GTTATATTGT ATACATGTTA TATATGTTAT AGCATATATA GTACAAGTTA |
| 1551 | TATATAACAC ATACATTATG TTACATATAA TGTATATGTT ATATATGATA |
| 1601 | TATTATATAT AATTATATAT TATATAAAAC TGTTATATAT AATTATATAT |
| 1651 | AATATATAGT TGTTATATAT AATTATATAA TTGTTATATA TTATATACAA |
| 1701 | CATATAACAT ACATTATATA TTGTTATATA TAATATAATA TATACATATA |
| 1751 | TAACATATGT ATAACTTTTA TGTTATACAT AATGTATATA ACATATATGT |
| 1801 | GTATGTGTGA TGTACATAAC ATATCTGACA TTAACATATA ACATATGATA |
| 1851 | TAACAATATT ATATGTTATA ACATAATATA TGTTATAATA TAACAATATT |
| 1901 | ATATGTTATA ACTTATACTG TCATATGTAA CATATACATA ATATTTTATA |
| 1951 | AATCAGTTTA ATATACATTA TGTTACATAT AATGTATGTT ATATATGATA |
| 2001 | TATTATATAT AATTATATTA TACATAATTG TTATATATAA TGCATACATT |
| 2051 | GTATTTGTTA CGTATTATAT GCAACATATG GGGATCCTCT AGAGTCGGAC |
| 2101 | CAGCGGCAGC AGCTGCCTGC CTTTTNNNNN NNNNNNNNNN NNNNNNNNNN |
| 2151 | NNNNNNNNNN NNNNNNNNNN NNNNNNNNNN NNNNNNNNNN NNNNNNNNNN |
| 2201 | NNNNNNNNNN NNNNNNNNNN NNNNNNNNNN NNNNNNNNNN NNNNNNNNNN |
| 2251 | ATATACATAC ATAACATATG TATAACTTAT ATGTTATATA TAAGTATATA |
| 2301 | ACATATATGT GTATGTGATG TATATAACAT ATCTGACATT AACATATAAC |
| 2351 | ATATGTTATA ATATGACATA TTATATATAT TACATATAAC GTATATCATG |
| 2401 | TATAATATAA TGTGTATATA TAATATATTA AAGTATATAA GTATAAATAC |
| 2451 | ATGTAATATT TAAATATATA TTATATATAG TATACATGTG GATACATACA |
| 2501 | ACTTCTACAT ATACCTAGTA TATATTCTAT ATATAAACAG TCCATGAATT |
| 2551 | ACAATGATTC AACTTATGAT TTTTCAAACT TTGTGATAAT GCCATAGCAA |
| 2601 | TATGCATTCA GTAGAAAGCA TACCTTCAAC ACCCATGCAA CCATTCTGTC |
| 2651 | ATTCACTTTC AGTACAATAT TCAATAAATT ATATGAGATA TTCAACAGTT |
| 2701 | TATTATAAAA TAGGCTTTGT GTTAGGTGAT TTTGCCCACA TGTAGGCTAA |
| 2751 | TGTAAGGGTT CAGAGCATGT TTAAGGTAGG ATAGGCTAAC CTATCATGTT |
| 2801 | CTGTAGGTTA GGTATAGTCG ATTTTTATTT TTATTTTTAT TTTTGAGACA |

TABLE 28-continued

Genomic Repeats
(SEQ ID NO: 312)

```
2851    GAGTCTTGCT CTGTCACCCA GACTGGAATG CACTGGTGCG ATCATAGCTC

2901    ACTGCAGCCT TGAACTCCTG GGCTCAAGTG ATCCTCCTAC CTCAGCCTCC

2951    TGAGTAGCTG GGACTACAGG TGTGTGCCAC CACACCTGGC TATTTTTTTT

3001    TTAATTTTTT TTTTTTTGTG GAGAGGAGGG TCTTGCCATG TTGCCCAGGT

3051    GGCCTTGAAC TCCTGGGCTC AAGGAATCCT CCCACCTTGG CCTCCCAAAA

3101    TCCTGGGATT ACAGGTGTGA GCCATCACGC CCGGCTACAG GGCATTTTTG

3151    ACTTATGACA TTTTCAGTTC ACAATGGATT TGTCAGGGCT GGGCATGATG

3201    GCTCACACCT GTCATCCCAG CACTTTGGGA GGCTGAGGCA GGTGGATCAC

3251    TTGAGGCCAG GAGTTTGAGA CCAGGCTGTC CAAATGGCAA AATCTTGTCT

3301    CTACTAAAAA TACAAAAATT AGCCAGGCGT GGTGTGACAA CTGTAGTTCC

3351    AGCTACTCGG GAGACTGAAG CGTGAGAATC ACTTGAACTT AGGAGATGGA

3401    AGTTACAGTG AGTCAAGATC ACACCACCGC ACTCCAGCCT GGATGACAGA

3451    GCAAGACTCT TGTCTCCAAA AACAAAAAA CAGGCTGGGT GCATGGCTCA

3501    TGCCTGTAAT CCCAGCAGTT TGGGAAGCTG AGGCAGGTTT ATCACCTGAG

3551    GTCAGTAGTT CACGATCAGC TTGGCAAACA TGGAGAAAAC CCATCTCTAC

3601    TAAATGTACA AAAATTAGCT GGATGTGGTG GTGGGTACCT GTAGTCCCAG

3651    CTACTCGGGA GGCTGAGGCA GGAGAATGGA TTGAACCTGG GAGGCAGAGG

3701    TTGCAGTGAG CCAAGATCAC ACCATTGAAC TCCAGCCTGG GCAACAGAGT

3751    GAGACTCCAT CTCCAAAAAC AAAAGAAAGC AAAACAAAA AATAAAATA

3801    AAAAACCTGT GTTTATCAGG ACATAATACC ATCATGAGTC AAGAAGCATC

3851    TAAATGTACA TGGTAGTTAT ATAAAAATAG TTATATAGTT ATATACAATA

3901    GTTATATATA AACCAGTTTA ATATATGTTA AGTAGAGGTA TATGGTAGTT

3951    ATATAAAAAA TAGTTATATA ATAGTTATAG AGTTATATAA TTATATAAAA

4001    TAGTTATATA TAAACCAGTT TAATATATGT TAGGTAGAGG TATAATAATA

4051    TATATTGTAT ATACTATATA ATATAGTAAT GTATAAAATG CAAAACGATA

4101    TCATATATTT CTATATTAAG TTTATATTTA CAGATCTACA TTTTATATAT

4151    TTTATGTTAT ATACAATTGT GTTATACATA ATATAATTAG TATAGTACTG

4201    ACTTGGGGAA TTGAGCAGTA CCAACCCATA GGGATGTTTG AGGATGAAAA

4251    TATGTGATTA TGAATACAAA ATGCTGGGCC TGCTGCATAG GAAGTATTTA

4301    ATAAATGGTA GTTGTTACTA TAAAGTCGTT CCTACTATAG AGCTACTCAC

4351    AACCTGGGAC ATAGGGAAAG AGCCCGTTTC CCTCTAATCA CTCAATAGTG

4401    GGTGGCTAGG TAGGTGAGTC CACATCCTGT GGCCGGGAAC AGGTGCTGAG

4451    ACATGAAGAC CTTCTGACTG CATGTTGGAC CAGCCACAGT TTCAGACGGA

4501    CCAGCCAAAA AGGGCATTTT CCCCAAGCCA TTTAGCTCCC TTGAGTCTCA

4551    TAACAAATCT CCTAGACCCT GCTGGTCCAT AGGATCTAGA GAGGATGACT

4601    TGAACCTTCT GATCCCACCA TTTGAAAACG CCATGCCATG GCACCAGTA

4651    GGAGGGCCAC TGCTACGTGC ACCAGTACAA GGGCCACTGC CATGGATTAC

4701    AGATTAACCC TAAGTATAGC TGTCGCACAC CTAGTACTTC AGGAGGCTTA
```

TABLE 28-continued

Genomic Repeats
(SEQ ID NO: 312)

| | |
|---|---|
| 4751 | TTCGGGGCCA TGCAGATCCC TGGCATTATT ATCCTAGGAT CCTACACCAA |
| 4801 | GCAAAGCAGG AGCTGCCCCT CCTCATAAAC CCATAAGCCC TCCTCTTGAG |
| 4851 | CAAAGCAGCT GGGAAGGCCA GAAGTTATTC AAGCTCCCCT CTGCCCCGGT |
| 4901 | TCCAAAGACA GACAGCTCAA GCCTACATGC AGCAAACCCT ATAAAAGTGT |
| 4951 | CACCTCTTGG CATTTCTGCC ATGGTAATGC TTTCTGCTTC CACTAATAAT |
| 5001 | CCTAGTAATT TGTTTATGGT GGGCATCTCT CTGATGAGAA CCACATTCTT |
| 5051 | TTTTTTTTTT TTTTTTTTTT TTGAGATAGA GTCTCACTCT GTTGCCCAGA |
| 5101 | CTGGAGTGCA GTGGCGCGAT CTCGGCTCAC TGTAACCTTT GGCTCCTAGG |
| 5151 | TTCAAGCAAT TCTCCTGCCT CAGCCTCCCA AGTAGCTGGG ACTGCAGGCA |
| 5201 | CGTACCACCA TGCCCAGCTA ATTTTTGTAT TTTTAGTTGA GACGGGGTTT |
| 5251 | CACCATGTTA GCCAGGATGG TCTCAATCTC TTGACCTCAT GATCCACCTG |
| 5301 | CCTTGGCCTC CCAAAGTGTT GGGATTACAG GCATGAGCCA CCATGCCTAG |
| 5351 | CCTGAGAGCC ACATTCTTGT AACCACAAT TTTCTCAGAG TCTGCATTAG |
| 5401 | GGGTTGACAA AGAGTGGAAA GGAAGGACAA AAGGATGGAG AGGTGGATGG |

Exon R3

| | |
|---|---|
| 5451 | ACTAAGCATA TGTAGGTTCT TACCCAGGCC AGAGAAGGAT AGCTCAGCCA |
| 5501 | CGGCAGTGGA TGCCATCTGC ACACATCGCC CTGACCCTGA AGACCTCGGA |
| 5551 | CTGGACAGAG AGCGACTGTA CTGGGAGCTG AGCAATCTGA CAAATGGCAT |
| 5601 | CCAGGAGCTG GGCCCCTACA CCCTGGACCG GAACAGTCTC TATGTCAATG |
| 5651 | GTGAGCAGCT GTGATGTGGT TGGAGGCTCT TCCTCCTTGC TGAGCAGCCT |
| 5701 | GTAATCACTG GCTTGAGGTC ACACTCACTG TCAGGCAATT GAAAATTTGG |
| 5751 | TCCTGTGCTC TACATGGGAT GACTAATTTC CGGACTTCAT GGTATCTTTT |
| 5801 | TTTTTTTTT TTTTTTTTTG AGATGGAGTC TCGCTCTGTC ACCAGGCTGA |
| 5851 | GGTGCAGTGG CATGATCTCA GCTCACTGCA ACCTCCGCCT CCCGGATTCA |
| 5901 | AGCAATTCTC CTGCCTCAGC CTCCTGAGTA GCTGGGACTA CAGGTGCATG |
| 5951 | CCACCACACC CAGCTAATTT TTGTATTTTT AGTAGAGACA GGGTTTCACC |
| 6001 | ATGTTGGTCA GGATGGTCTC AATCTCTTGA CCTTCTACTC CACCTTGCCT |
| 6051 | TGGCCTCCCA AAGTACTGGG ATTACAGGCT TGAGCCACCA CACCTGGCCA |
| 6101 | GGACTTCATG GTTTCTTCAT CATCATGGAA TGAATTCCAT CAGGGCATTC |
| 6151 | TTCCCTGATG TGAGGGCACT GATAGGAAAT CTTTAATGGT CCCTGCTGCA |
| 6201 | TGAAACTGCT TCCATTGCAC CAGGGTAGCC CTGACCCCTA TTTGGTCCCC |
| 6251 | CACATCTCCT TGTAACTTAC CCACACTCCT CCCTCCTTCT CTGTGCAGGT |

Exon R4

| | |
|---|---|
| 6301 | TTCACCCATC GAAGCTCTAT GCCCACCACC AGCAGTGAGT ATTCAACTCA |
| 6351 | TGTCCACATG CCCATGATCC TACACCAAGC AAAGCAGGAG CTGCCCCTCC |
| 6401 | TCATAAACCC ATAAGTCCTC CTCTTGAGCA AGTAGCTGG GAAGGCAGAA |
| 6451 | GTTATTCAAG CTCCCCTCTG CCCCAGTTTC AAAGACAGAC TCAGCTCAAG |
| 6501 | CCCACATGCA GCAAACCCTA TAAAGTCTC ACCTCTTGGC ATTTCTGCCA |
| 6551 | TGGTAATGCT TTCTGCTCTC ACTAATGAGG ACTTCTCCTC AGCTCCTGGG |

TABLE 28-continued

Genomic Repeats
(SEQ ID NO: 312)

Exon R5

| | |
|---|---|
| 6601 | ACCTCCACAG TGGATGTGGG AACCTCAGGG ACTCCATCCT CCAGCCCCAG |
| 6651 | CCCCACGAGT AAGTACCAGT CAATGGCATC TCTATTAGAG CATGCTATCT |
| 6701 | CTGTCATTTT TACTCAGATG AAGATGGAAA ATCATAGCAA ATCTACTGAT |
| 6751 | AGTGAGTGGA CCAACGAAAT TTGTTGGCCA CCTAGTGTGT ACCAGATCCT |
| 6801 | AGAGATACAG GAGGGAAAAC AAAACCAATA CAAAATTTCT GCTCTCAGTG |
| 6851 | AGCTTGTATT CTTGTCATGA TGATGATGTT GGTGGTGGTG CTGTTGATGA |
| 6901 | CGATGATGAT GATGATGATG ATGATGATGC TGGTGATACT GTTGATGGTG |
| 6951 | ATAGTGATGT TGATGACAAT GATGATGATG ATGATGTTGA AGAAAATGAT |
| 7001 | GCTGGTGATG GTGGTGGGGG TTATTATGGT AATAATGATA TGTTGAGTGT |
| 7051 | GACGATGATG GTGGTGGTGT TGATGATGAT GATGATTATT ATGCTAGTGA |
| 7101 | CATTGATGAT GGTAATGGTG ATATCAACGA CAGTGACAAT GATGGTGATG |
| 7151 | AGGATGATGT CGGTGATGGT GGTGGGGTTA TGATGGTAAT GATATGTTGA |
| 7201 | ATGTGATGAT GGTGATGATG ATATTTGTGG TTCATGATGG GGATTGTCAT |
| 7251 | GGTGGTGCTG GTGGTACTTG TGATGACAAT AATGATAATA ATGATGACAA |
| 7301 | TGATAGTGAT GATGGTGATG GTGATAATAA AGATAACAGA TATCACCTTA |
| 7351 | CAATATTGAG CACTAAATAT GTACCAAGAG CTATGCTCAG TATCTAACTA |
| 7401 | CTATTATATA ATCTACTTTA GAAAATGAAT TGTATCATAG ATAAGAAAGG |
| 7451 | CGTGGAAAAT ATTTATTATG TCACTCAATT TAATTGCTGC ATATGGTTAT |
| 7501 | TACAAAGTGC TATTCTCTCT ACTTTGAACA TAATGTTTAT TTCACACTCC |

Exon R1

| | |
|---|---|
| 7551 | CACTATAGCT GCTGGCCCTC TCCTGATGCC GTTCACCCTC AACTTCACCA |
| 7601 | TCACCAACCT GCAGTACGAG GAGGACATGC GTCGCACTGG CTCCAGGAAG |
| 7651 | TTCAACACCA TGGAGAGTGT CCTGCAGGGT CTGGTTAGTG TCCTGCCCTC |
| 7701 | CACACTCTGC CCTGCTCATG ATACCCAGTC CCTCTTACAT CATCCATGCC |
| 7751 | AGGGCAATGG AAGAATATCA AACCCAACTC ACTTTTGCCC CAAGAGATGC |
| 7801 | AAGCCTCAGC CAGGAGCGGT GGCTCACGCC TGTAATACCA GCATTTGGGA |
| 7851 | GGCCAAGGCG GTGGATCAC CTGAGGTCAG GAGTTTGTGA CCAGCCTGGC |
| 7901 | CAACATAGTG AAACCTCATC CCTACTAAAA TACAAAAATT AGCCAAGCAT |
| 7951 | GGTGGTGCAT GCCTGTAATC CCAGCTACTT GGGAGGGTGA GGCAAGAGAA |
| 8001 | TCACTTGAAT CAAGGAGGCA GAGGTTGCAG TGAGTCAAGA TCATGCCACT |
| 8051 | TTACTCCAGC CTAGGCAAAA AAGCGAAACT CCATCTCACA AAAAAAGAA |
| 8101 | AAAAGAGAG AGATGCAAGC CTCCCCCACC AAGGCCAGCC CTGCCCACCT |
| 8151 | CACTTCTGCC TGGCTCTTAC ATAAAACTTA GCCCTCCTAC TCACTGCCCT |

Exon R2

| | |
|---|---|
| 8201 | CTCCCTCCTC CACAGCTCAA GCCCTTGTTC AAGAACACCA GTGTTGGCCC |
| 8251 | TCTGTACTCT GGCTGCAGAT TGACCTTGCT CAGGTGAGAA CTTAGAATTT |
| 8301 | CCAGCCTGGC TGCCCCACTT GTACTCACTC CAAAAGACTT TGCACTGCTT |

TABLE 28-continued

Genomic Repeats
(SEQ ID NO: 312)

| | |
|---|---|
| 8351 | CCTTGCTGCA CTTCCTAGGG ATATCCTCAC CAAAGGTGGA ATTCAGGAGT |
| 8401 | CACAGGCTTC AGGATCAGTG TGTTTCCTGA CAGTAACACC CCTACACTCC |
| 8451 | ACCTCAACAG AGAGAATCTG CATGGCCCAT CATCAGGATT GAGCCTCTCC |
| 8501 | CTTTATCATC CCTCTGAATT CCCTCCATTC CCTGTGCCTC CCTTTCCTTT |
| 8551 | ACATGTTAAA TTCTGTCCCC AGGATTTCTT TCAGGACAAT CATGCCTTAT |
| 8601 | CCACGTGATT TCATCCTCAT TTCGAGCTCT TCACTGGGCT CAAGTCCGGC |
| 8651 | TCCCCGTCCC GTCCATGAAA GTGTCAGTTT CATCTTGTCA CTGTATCCGT |
| 8701 | GACTCCACTC ACAGTCCTCA GCAAGCCAAT AGTCCATGCA CTAAGAGTCG |
| 8751 | ATGTGGCTTC TCACCTCTTT CCCAGGTTTC TCATTTCTCT GGTCCTTGCT |
| 8801 | GTCCTTCCCT CAGCAATCGC AAGACCCTTC CTAGATAAAC TTTTCATTGT |

Exon R3

| | |
|---|---|
| 8851 | GATTTTTCCC ACTGACCCTC CCCAGGCCCG AGAAAGATGG GGCAGCCACT |
| 8901 | GGAGTGGATG CCATCTGCAC CCACCGCCTT GACCCCAAAA GCCCTGGACT |
| 8951 | CAACAGGGAG CAGCTGTACT GGGAGCTAAG CAAACTGACC AATGACATTG |
| 9001 | AAGAGCTGGG CCCCTACACC CTGGACAGGA ACAGTCTCTA TGTCAATGGT |
| 9051 | GAGTGGCTGT GATGTGGTTG AAATCTCTTC CCCCTTGCTG GGCAGCCTCT |
| 9101 | AATCTCTAAC TAGAGATCAC ACTCCCTGCC TGGCCTTTGA AAATTCTGTC |
| 9151 | ATGTGCTCTA CATGGGATGA CTAAGGTCTG GACTTCATGG TTTCCTTACC |
| 9201 | ATCATGGACT GTGTTCCCTC AGGGCATTCT TTCCTGATGT GAGGATGCTG |
| 9251 | ATAGAAAATC TTCAATTGTC CCTGTACCAT GAAACTCGGT TCATTGCACC |
| 9301 | AGGGTAGCAT TGACCTCCAT TTGGTCCCCC ACCTCTCCTT GTCTCTTACC |

Exon R4

| | |
|---|---|
| 9351 | CACTCTCCTC CCTCCTTCTC TATGCAGGTT TCACCCATCA GAGCTCTGTG |
| 9401 | TCCACCACCA GCAGTGAGTA TTCAACTCAT ATCCACATGC CTCGGTTCCT |
| 9451 | ACACCAAGAG GAGCAGGAGC TGGCCCCTCC TCATAAACCC ATTAAGTCCT |
| 9501 | CTTCATAAGC AAAGGATTTA GGAGGGCAGA AGTTATTTAA GTGTCCCTCT |
| 9551 | GCCCAGCTCA AGAGACCGAC CCAGCTCAAG CTACACATGC AACAAACCCC |
| 9601 | ATAAATAGTC TCCCCTCTTG CCATTTCTGC CAAGAGAGTG CTTTATGCTT |

Exon R5

| | |
|---|---|
| 9651 | TCACTGATGA GAACTTTTCC TCAGCTCCTG GGACCTCCAC AGTGGATCTC |
| 9701 | AGAACCTCAG GGACTCCATC CTCCCTCTCC AGCCCACAA GTAAGTATCA |
| 9751 | GTCAATGACA TCTCTATGAG AGCATACCTG ATTAGTGTAA ACATCTCTGT |
| 9801 | CATTTTCACT CAAATAAAGA TGGAAAATCA TAGTAAATCT AGTGATACTG |
| 9851 | AGTGGACAAA TTTGTTTGTT TGTTTTTTCT CATCCTTTTC ACTTTTTTTA |
| 9901 | TTATACTTTA AGTTTTAGGG TACATGTGCA CAATGTGCAG TTTAGTTACA |
| 9951 | CATGTATACA TGTGCCATGC TGGTGTGCTG CACCCATTTG CTCGTCATTT |
| 10001 | AGCATTAAGT ATATGTCCTA TGCGATCCAA GCCCACGCGC CGCACCACGT |
| 10051 | GCAACAGTTT CACAGATTGG ATGGTCCGAT ANNNNNNNNN NNNNNNNNNN |

TABLE 28-continued

Genomic Repeats
(SEQ ID NO: 312)

10101 NNNNNNNNNN NNNNNNNNNN NNNNNNNNNN NNNNNNNNNN NNNNNNNNNN

10151 NNNNNNNNNN NNNNNNNNNN NNNNNNNNNN NNNNNNNNNN NNNNNNNNNN

Exon R1

10201 CTTCACCATC ACCAACCTGC AGTATGAGGA GGACATGCAT CGCCCTGGAT

10251 CTAGGAAGTT CAACACCACA GAGAGGGTCC TGCAGGGTCT GGTTAGCACC

10301 CTGCCCTCTT CACTCTCCCC CGCCCTGGAT GCCGAGCCCC TCATACAACA

10351 TTCATGCCAG GGCAATGGAA GAATATCGCA CCAACCTTGC CCTCATCCCC

10401 AGAGATGCAA GCCTCACCCA CTGAGGCCAG CCACTCTCAT GGGTGTCTGC

10451 CCCACCCACC TCACTTTTGT CCCCACACAG GGACCTTAGC CCTCCTACTT

Exon R2

10501 ACCTCTCTCT CCCTCCCCCA CAGCTTAGTC CCATATTCAA GAACACCAGT

10551 GTTGGCCCTC TGTACTCTGG CTGCAGACTG ACCTCTCTCA GGTGAGACCT

10601 TAGAAGATCC AGCCTGGCTG CCCCAGTTGT TCCCACTCCA GTAGATTTTG

10651 CTCTGCTTCC TTGCTGCACC TCCTAGGGAT ATCCTCACCA AAAGGGGAAT

10701 TCAGGAGTCA CTGGCTTCTG GACCAATGTG TTTCCTGATA GTAACACTCC

10751 CACACCTCAC CTCAACAGGG AGAATCTGCA TGGTCCATCA TCAGGATTGA

10801 GCCTCTATCC TGATCATCCC TCAGAATTCC CTGCCCCTCC CTTTCATTTA

10851 GGTGTTAAAT TCTGTCCCCA GAATTTCTCT CAAGACAATC ATGCCTCATC

10901 CAAGTGCTTT CATCCCTGTT CTAGCTCTT CACTGGTCTC AAGTCTGGGC

10951 TCTCCTGTCC CCATGCTATG AGAATGCAGG TTTCACCTTG CACTTTTATA

11001 AGCATGGTTG TATCTGTGAC TCTGTGCACA GTCCCAAGCA AGCCAGTAGT

11051 CCATGCACTC AGAGAATCTA AGTGTAGCTT CTCACCTCTT TCCCAGGTTT

11101 CTCATTTCCT CTGGTTCTTT ACTGTCTTTC CATCAGCAGT CTCAGGACAC

Exon R3

11151 AACCTAAGTA ATCTTTTCAT AGTCATTCTC CCCACCTACC TTCCCCAGGT

11201 CTGAGAAGGA TGGAGCAGCC ACTGGAGTGG ATGCCATCTG CATCCATCAT

11251 CTTGACCCCA AAAGCCCTGG ACTCAACAGA GAGCGGCTGT ACTGGGAGCT

11301 GAGCCGACTG ACCAATGGCA TCAAAGAGCT GGGCCCCTAC ACCCTGGACA

11351 GGAACAGTCT CTATGTCAAT GGTGAGCAGC TGTGATGTGG TTGGAGTCTT

11401 TTCCTTCTAG AGTCTGGAAA GAATCTAATC TGTGGCTTGA AGTCACACTC

11451 CCTGCCTGGC CATTGAATAT TCTGTCATGT GGTGTAGATG GGATGACAAA

11501 GTTCTGGACT TCACAGTTTC TTCATTGTCG TGAACTGTGT TCCCTCAGGG

11551 CACTCTTCCC TGTTGTGAGG ATACTGATAG GAATTCTTTA ATGGCCCCAG

11601 TCCCATGAAA CTCATTGTCC CATGAAACTC ATTTAATTGC ATTGGGATTG

11651 CCATGACCTT ATTGTGTCCC TCGTATCTCC TTAACGCTTA CCAAGTCTCC

Exon R4

11701 TCCCTCCTTC TCTATGCAGG TTTCACCCAT CGGACCTCTG TGCCCACCAC

11751 CAGCAGTGAG TATTCAACTC ATGTCCACAT GCCCCTGATC CTACATTAAG

11801 TGGAGCAGGA GCTGGCCCCT CCTCTTAAAC CCATAAGTCC TCCTCTTGAG

TABLE 28-continued

Genomic Repeats
(SEQ ID NO: 312)

| | |
|---|---|
| 11851 | CAAAGGAGCT GGGAAGGCAG AAGTTATTGA AGCTCCCTTC CACCTAGCTC |
| 11901 | CAAAGACAGG CCCAGCTCAT GCCCGTATGC AGCAGACCTC ATAATAGTCT |
| 11951 | ACCTTCTTGC CATTTCTGCC ATGAGATTAT TTTCTGCTTT CACTGATGAG |

Exon R5

| | |
|---|---|
| 12001 | CACTTTTTCT CAGCTCCTGG GACCTCCACA GTGGACNNNN NNNNNNNNNN |
| 12051 | NNNNNNNNNN NNNNNNNNNN NNNNNNNNNN NNNNNNNNNN NNNNNNNNNN |
| 12101 | NNNNNNNNNN NNNNNNNNNN NNNNNNNNNN NNNNNNNNNN NNNNNNNNNN |

Exon R1

| | |
|---|---|
| 12151 | ATTTTCAATT CCCACTACAG CTGCTGGCCC TCTCCTGGTG CTGTTCACCC |
| 12201 | TCAACTTCAC CATCACCAAC CTGAAGTATG AGGAGGACAT GCATCGCCCT |
| 12251 | GGCTCCAGGA AGTTCAACAC CACTGAGAGG GTCCTGCAGA CTCTGGTTAG |
| 12301 | TGCCCTTCCC TCCTCACTCT GCCCAGCCCC AGATATCCAG TCCCTTCTAC |
| 12351 | ATCATCCATG CCAGGGTGAT GAAAGAAGAT AGCAACAACT TCCCCCCTTC |
| 12401 | CCCCCAAGAG ATGCAAGCCC CACCCACAGA GACCAGTCCT GCTTATTGGT |
| 12451 | GCCTGCTCCA CCCACCTCAC ATCTGCCCCG ACACACACAC ACCTTAGCCC |

Exon R2

| | |
|---|---|
| 12501 | CACTACTCAC CTCCCTCTCC CTCCTCTACA GCTTGGTCCT ATGTTCAAGA |
| 12551 | ACACCAGTGT TGGCCTTCTG TACTCTGGCT GCAGACTGAC CTTGCTCAGG |
| 12601 | TGAGACTTTA AAGAGCCAG CCTGGGTGCC CAAACTTGTT CCCACTCTAA |
| 12651 | AAGACTTTGC ACTGCTTCCT TGCTGCACTT CCTAGGTATA TCTTCACCAC |
| 12701 | AAGGGGAATT CAGGAGTCAT TGGCTTGAGA ACCAGTTGTT TCCTGATAGT |
| 12751 | AACACCCCCA TGCCCCAACT CAACATGCAA ATCTTCATG GTTCATCATC |
| 12801 | AGGATTGAGA CACTACCCTG ATTACCCATC TGAATTCCCT CCTTTCCCTG |
| 12851 | ACCCCTCCCT TTCATTTAGG TGTTAAATTC TGTCCCCAGG ATTTCTCTCA |
| 12901 | AGATAACCAT GCCTCATCCA CATACATGCA TCCGCCTTTC AAGCTCATCA |
| 12951 | CTAGTCTGAA GCTCTGGGTT CTCCTGTTCC CATGCCATGA GAATGCAGGT |
| 13001 | TTCACCTTGC ACTTTTATAA AAATTATTAT ATCCATGACT CTGCTTGCAG |
| 13051 | TCCCAGACCA AGATAGTGGT CTATGTACTC AGATAATCTA AGTGCAGATT |
| 13101 | CTCACCTCTT TCCCAGATTT CTCATTTCCT CTGGTTCCTT GATATGTTTC |
| 13151 | CCTCAGCAAT CTCAAGACAA GTCCTAGGCA ATCTTTTCAT TGTCATTCCC |

Exon R3

| | |
|---|---|
| 13201 | CCTCCTACCT TCCTCAGGTC CGAGAAGGAT GGAGCAGCCA CTGGAGTGGA |
| 13251 | TGCCATCTGC ACCCACCGTC TTGACCCCAA AAGCCCTGGA GTGGACAGGG |
| 13301 | AGCAGCTATA CTGGGAGCTG AGCCAGCTGA CCAATGGCAT CAAAGAGCTG |
| 13351 | GGCCCCTACA CCCTGGACAG GAACAGTCTC TATGTCAATG GTGAGCAGCT |
| 13401 | GTGATATGGT AGGGGTCTCT TCCTCCTGGC TGTGCAACCA TCTAATCTCT |
| 13451 | GGCTTGGGGG CACACTCCCT GCCTGGCCAT TGAAAATTCT GTCACGTGCT |
| 13501 | CTACATGGGA TGACTAAGTT CTGGACTTCA TGGTTTCTTT GTTATCATGA |

TABLE 28-continued

| Genomic Repeats (SEQ ID NO: 312) |
|---|

| 13551 | GAGGCATTCC CTCTGGGCAC TCTTCCCTGT TGTGAGGATG CTGATAGGAA |
| 13601 | ATCTTTAATG ACCCCTGTCC CATGAAACTC ATTTAATTGC ACCAGGGTAG |
| 13651 | TCCTGAACTC TATCGCGTCC CCCACATCTC CTTAACCCTT ACCCAGTCTC |

| Exon R4 |
|---|

| 13701 | CTCCCTCCTT CTCTATGCAG GT<u>TTCACCCA TTGGATCCCT GTGCCCACCA</u> |
| 13751 | <u>GCAGCAG</u>TGA GTATTCAACT CATGTCCATG ATGCCCCTGA TCCTACATCA |
| 13801 | AGTGGAGCAA GAGCTGGCCC CTCCTCTTTA ACCCATAAGT CCTCCTCTTG |
| 13851 | AGCAAATGAG CTGGGAAGGC AGAAGTTACT CAAGCTCCCC TCTGCCCCAG |
| 13901 | CTCCAAAGAC AGACCCAGCT CAAGCCCACA TGCAGCAGAC CTCATAATAG |
| 13951 | TCTATCTTCT TGCCATTTCT GCCATGAGAG TGCTTTCTGC TTTCACTGAT |

| Exon R5 |
|---|

| 14001 | GAGGACTTTT TTCAG<u>CTCCT GGGACCTCCA CAGTGGACCT TGGGTCAGGG</u> |
| 14051 | <u>ACTCCATCCT CCCTCCCCAG CCCCACA</u>AGT AAGTACCAGC CAATGGTATC |
| 14101 | TGTATTAGAT CATGCCTGAT GAATGCAAAC ATCTGTGCCA TTTTCAGTCA |
| 14151 | AATGAAAATG GAAAATCATA ATAAATCTAG TGATACTGAG TGAACCAAAA |
| 14201 | AAAATGTATT GGCCACCTAC AGTGTACCAG ACCCTAGGGA TATAGCAAGG |
| 14251 | AAAATAGAAC CAATAAAAAC ATCTCTGCCC TCAGTGAGCT TGTGTTCATG |
| 14301 | TGATGATATG ATGGTGGTGG TGGTGGTAAT AGTAATAATG ACATATTCAG |
| 14351 | TTTGATGATA ATTTATGATT ATGGTGTTGC TGTTGATGAT GGTGGTGGTG |
| 14401 | ATGTTACTGA CAATGATGGT GACGGATCTT TGAGGATATT GTCCGTGATG |
| 14451 | GTCGTGAAGA TTATGATGAT AATGATGATG TGTTAAGTGT GATGATGATG |
| 14501 | ATGATCTGTG GTGATGCTGT TTAGGATGCT GTTCCGTGGT ACCGATGATA |
| 14551 | TTGATGTTGG TCGTGGTTAT GTTGTATGAC AATGACAATG ATGGTGATGA |
| 14601 | GGATAATCGC CAGTGATGGT GTGGGTTTAT GATGATGATG ATGTGTTGAA |
| 14651 | TGTGGTGATG ATAATGTTCG TGGTGGTCGT GATGGGCATT ACTATGGCAG |
| 14701 | TGATGGTCAT AATAATGATG GTGATGGTGA CAATGATAGC AAGGATGATG |
| 14751 | ATGGCAATAA AGATAGTACA TAACATCAGA CAATATTGAG CTCTGAATAT |
| 14801 | GCACCACGAG GAGTGCTCAG CATCTAAATA CTATTATATA ATATATTTTT |
| 14851 | GTAAAAATAA ATTGTATTGT TTTAGGCAAG GGAAGCATGG TAAATATTTT |
| 14901 | GTCACTCAAT TTAAATTCTG CATATGTTTA AAGATAAGTC TATTGCAAAC |
| 14951 | TCCTATTTTC TCTACTTTGG ACATAGTGTT TGTTTCCCAC CTCCACTACA |

| Exon R1 |
|---|

| 15001 | <u>GCTGCTGGCC CTCTCCTGGT GCCATTCACC CTCAACTTCA CCATCACCAA</u> |
| 15051 | <u>CCTGCAGTAC GAGGAGGACA TGCATCACCC AGGCTCCAGG AAGTTCAACA</u> |
| 15101 | <u>CCACGGAGCG GGTCCTGCAG GGTCTGGTTA</u> GTGCTCCACC CTCCTCACTC |
| 15151 | CGCCCCACCC CAGAGAGTCA GTACCTCCTA CATCATCCAT GCCAGGTGAT |
| 15201 | GGAACAAGAT CATACCCACC TCACCCTTGC CCCAAGAGAT GCAAGCCATG |
| 15251 | CCCATTGAAA CCAGCCCCAC TCACTGATGC CTGTTACTGC CCCACCTGAC |
| 15301 | TTCTGCCCTA CACACCCACA CACGCAACTT AGCCCTCCTA CTCATCTCCT |

TABLE 28-continued

Genomic Repeats
(SEQ ID NO: 312)

Exon R2

| | |
|---|---|
| 15351 | TCTCCCTCCT CCACAGCTTG GTCCCATGTT CAAGAACACC AGTGTCGGCC |
| 15401 | TTCTGTACTC TGGCTGCAGA CTGACCTTGC TCAGGTGAGA CCTTAGAAGA |
| 15451 | TCAAGCTTGG CTGCCCCACT TGTTNNNNNN NNNNNNNNNN NNNNNNNNNN |
| 15501 | NNNNNNNNNN NNNNNNNNNN NNNNNNNNNN NNNNNNNNNN NNNNNNNNNN |
| 15551 | NNNNNNNNNN NNNNNNNNNN NNNNNNNNNN NNNNNNNNNN NNNNNNNNNN |

Exon R1

| | |
|---|---|
| 15601 | NGTGTTAGTC TACTTTTGAA CACTGTTTAT TTCCCATCTT CACTATAGCC |
| 15651 | GCCAGCCCTC TCCTGGTGCT ATTCACAATT AACTTCACCA TCACTAACCT |
| 15701 | GCGGTATGAG GAGAACATGC ATCAGCCTGG CTCTAGAAAG TTTAACACCA |
| 15751 | CGGAGAGAGT CCTTCAGGGT CTGGTAAGAG CCCCACATAC CTCATTCTAC |
| 15801 | CGCCACTCAC CATGTTTAGT CCTGCCCACC TCACCTATTG CAGAGCATGG |
| 15851 | AAGATCTCAT CTACCTCATC TTGCCCCCAG ATATGCATAC CCCAACCACT |
| 15901 | GATGCCAGCC CCACCAACTG TTGCCAGCCC TGCCCACCTC CCTTCTACCA |
| 15951 | CACCCCTATG ACTTCAGTCC TCCCACTCAC CTCCCTCTCC CTCCTCCACA |

Exon R2

| | |
|---|---|
| 16001 | GCTCAGGCCT GTGTTCAAGA ACACCAGTGT TGGCCCTCTG TACTCTGGCT |
| 16051 | GCAGACTGAC CTTGCTCAGG TGAGAACTGA GAACAGCCAG TCTGACTGAT |
| 16101 | CTGAGCAGTT TGACCTGCTT CCCTTCTGCA CTCCCTGGAG ATGTCCGCAG |
| 16151 | CCAGGTGGAA TCCAGGAGGC AGTGGCTCTA AGACCAATGT GCTTCCTGTT |
| 16201 | CCCACCACCT CCCACCTCAA CTGAGAGATG CAGAGCCCAT CAGCAGGACT |
| 16251 | GAGCTTCTAC CTTGGTCATC CCTCTGAATT CCCTCCTTTC CCCTACCTGC |
| 16301 | CTTTCCACAA GTGGTTCAAT TCTGTTCCCA GGATTCTCC CAAGAAAAAC |
| 16351 | ATGCCTCGTC CACTTGCTTT CATCCCCAAA CCTAGCTCTT CACCTGTCTC |
| 16401 | AAGTATGAGT TCTCCTTACC CCATGCTACA AGAATGCAGT TTCCACTTTG |
| 16451 | CAATTTTATA AAAATCCTTG CATCCATGAT TCTGCTCATA GTTGCTAAGA |
| 16501 | GTCAGTGCAC TCAGAGAATG GAAGTATGGC TTCTCACTTC TCTACCAGGC |
| 16551 | TTCTCATTTC CTCTGGCCCC CTCCTGTCCT GCCCTGTGGG ATCTCAGAAC |
| 16601 | CCCTCCCTAG GCAATCCGTG TATTGTCTTT CCCCAATCTT GCCCTCCCCA |

Exon R3

| | |
|---|---|
| 16651 | GGCCCAAGAA GGATGGGGCA GCCACCAAAG TGGATGCCAT CTGCACTTAC |
| 16701 | CGCCCTGATC CCAAAAGCCC TGGACTGGAC AGAGAGCAGC TATACTGGGA |
| 16751 | GCTGAGCCAG CTGACCCACA GCATCACTGA GCTGGGCCCC TACACACTGG |
| 16801 | ACAGGGACAG TCTCTATGTC AATGGTGAGT AGTTGTGATG TGGTTGGAGT |
| 16851 | CTCTTCCTCC TTGCTGGGCA GCCTCTACTC TCTGCCTTGA GGTCACGCTC |
| 16901 | CCTGCCTGGC TATTGAATGC TCATCCATGT TGTCTGTATG TGATGGCTGA |
| 16951 | GGTTGGAACT TCATGGTTTC TATTTCATCT TGGACTGAGT TCATCCTCAG |
| 17001 | GATCTGCTTT CTGGATCTGA GGGTGCTGAT AGAGAATCTT CAATGGTTCG |

TABLE 28-continued

Genomic Repeats
(SEQ ID NO: 312)

| | |
|---|---|
| 17051 | TGTTCTGGGA AATTCCTTCC ATTGCACCAG GGTACCCTGA CCCCTATATA |
| 17101 | GTTCCCCACC ACTCCCTTAA CCCTTACCCA CCCTCTTCCC TCCCTCTCTA |

Exon R4

| | |
|---|---|
| 17151 | TGCAGGTTTC ACACAGCGGA GCTCTGTGCC CACCACTAGC AGTGAGTATC |
| 17201 | CACTGATTTC CAGTGCTCCT GATCCTACAT CATGCAGGGC AAGAACTGAC |
| 17251 | CCCTCCTCAC ATGCCCCTAT GTCCTCTATG AGCAAAGGAG CTGGGACAGC |
| 17301 | ACAAGTTACT CCCTTTCCCT TCTGGCCCAA GTCTCTTCAG AGAGAGACCC |
| 17351 | AGCTCAAGCC CCACATGCAG CAAGGTCCAT AAATACTCCT ACCTGCTGGC |
| 17401 | ATTTCTGCCA TGAGAGGGTT CAACACTTTC ACTAATGAGG CCTTCTCCTC |

Exon R5

| | |
|---|---|
| 17451 | AGTTCCTGGG ACCCCCACAG TGGACCTGGG AACATCTGGG ACTCCAGTTT |
| 17501 | CTAAACCTGG TCCCTCGGGT AAGTACAAAT CAATCGCATC TCTGTTAGAG |
| 17551 | CATGCCTGAT GACTGTCAAC ATCTCTGCCA TTTTCACTTA AATAAAGATA |
| 17601 | AAAAATCCTA GTGAATCTAC GGATGAGGAG TCATCCAGCA AACTTAATTG |
| 17651 | AGTGCCTAGT TTCTGCAGGG CTCTAGGGAT AAGAAAGGGG ACACAAAACA |
| 17701 | GTTAAAAATA TCTGCTGCAA GAAAGCTTAT TTTATTGTGA GGGTGATGGG |
| 17751 | AGTTGGTGGT GGTGAAGTTA CTGGAGATGA TGACAATAAG AATGGTGATG |
| 17801 | CTAGTGATGA TGATGGTGAT AAGGATGATA ATTATGAAGA TGGTGGTGGT |
| 17851 | GATGATGATG ATGGTNNNNN NNNNNNNNNN NNNNNNNNNN NNNNNNNNNN |
| 17901 | NNNNNNNNNN NNNNNNNNNN NNNNNNNNNN NNNNNNNNNN NNNNNNNNNN |
| 17951 | NNNNNNNNNN NNNNNNNNNN NNNNNNNNNN NNNNNNNNNN NNNNNNNNNN |
| 18001 | NNNNNNNNNN NNNNNNNNNN NNNNNNNNNN NNNNNNNNNN NNNNNNNNNN |
| 18051 | NNNNNNNNNN NNNNNNNNNN NNNNNNNNNN NNNNNNNNNN NNNNNNNNNN |
| 18101 | NNNNNNNNNN NNNNNNNNNN NNNNNNNNNN NNNNNNNNNN NNNNNNNNNN |
| 18151 | NNNNNNNNNN NNNNNNNNNN NNNNNNNNNN NNNNNNNNNN NNNNNNNNNN |
| 18201 | NNNNNNNNNN NNNNNNNNNN NNNNNNNNNN NNNNNNNNNN NNNNNNNNNN |
| 18251 | NNNNNNNNNN NNNNNNNNNN NNNNNNNNNN NNNNNNNNNN NNNNNNNNNN |
| 18301 | NNNNNNNNNN NNNNNNNNNN NNNNNNNNNN NNNNNNNNNN NNNNNNNNNN |
| 18351 | NNNNNNNNNN NNNNNNNNNN NNNNNNNNNN NNNNNNNNNN NNNNNNNNNN |
| 18401 | NNNNNNNNNN NNNNNNNNNN NNNNNNNNNN NNNNNNNNNN NNNNNNNNNN |
| 18451 | NNNNNNNNNN NNNNNNNNNN NNNNNNNNNN NNNNNNNNNN NNNNNNNNNN |

Exon R1

| | |
|---|---|
| 18501 | NNNNNNNNNN NNNNNNNNNN NNNNNNNNNN NGCTGCCAGC CCTCTCCTGG |
| 18551 | TGCTATTCAC TCTCAACTTC ACCATCACCA ACCTGCGGTA TGAGGAGAAC |
| 18601 | ATGCAGCACC CTGGCTCCAG GAAGTTCAAC ACCACGGAGA GGGTCCTTCA |
| 18651 | GGGCCTGNNN NNNNNNNNNN NNNNNNNNNN NNNNNNNNNN NNNNNNNNNN |
| 18701 | NNNNNNNNNN NNNNNNNNNN NNNNNNNNNN NNNNNNNNNN NNNNNNNNNN |
| 18751 | NNNNNNNNNN NNNNNNNNNN NNNNNNNNNN NNNNNNNNNN NNNNNNNNNN |
| 18801 | NNNNNNNNNN NNNNNNNNNN NNNNNNNNNN NNNNNNNNNN NNNNNNNNNN |

TABLE 28-continued

Genomic Repeats
(SEQ ID NO: 312)

Exon R2

18851 NNNNNNNNNN NNNNNNNNNN NNNNNNNNNN NNNNNNNCTC AGGTCCCTGT
18901 TCAAGAGCAC CAGTGTTGGC CCTCTGTACT CTGGCTGCAG ACTGACTTTG
18951 CTCAGGNNNN NNNNNNNNNN NNNNNNNNNN NNNNNNNNNN NNNNNAGAAT
19001 TCAGTCGACC TACCGGCTTT GATGATTGCT CAGTTGAACT TAGAAATGCA
19051 CTGTCTGCCC AATGGTCCAG TCTCATGAGT GTGACTCTTT TCTGCCTCTC
19101 TTGGGTATCT GATCAAGATG GACTCAGGAA AAGTGCTCCA GATAACTGTC
19151 TCCAATATAA CACTGCCCCT GCCATCACAC CCAAATGACT GGAAGTTTCA
19201 CAGGGTCATC AGCAGGGATT GGACTTCCAC CCCGGCCATC CCTCTGAATT
19251 TTCCCTCTTT TCTCCCCACC TCCCTTGCCC TTAGGTGTTA AAATTCTCTA
19301 ACTAAGATTT CTCTCAAGAC AAATGTGCCT CATTCACTTG TTTAATTCCC
19351 AATTCCAGCT TGTCACCTGT CTCAAGTCTA GGCTGTCCTG TCCCCATGCC
19401 ATGAGAATGC AAGAACCACA CTGAAATGTT AGAAAAATTC TTTTATCCAC
19451 AAGTATGCTC ACCGTCCCAA GCTGGACAGT AGTCAGTGCA CTCAGAGAAT
19501 CTAAGTGTGG CTTCTCATCT GTGTACCAGG CTTCTCATTT CCTGTGGGCC
19551 CTTCTTGTCC TTCCCTCCGC AATCTTGGGA CTCCTCCCTA GACAAAACTT

Exon R3

19601 TATTATTATT CCCCTCACCT GCCCTCTCCA GGCCTGAAAA GGATGGGACA
19651 GCCACTGGAG TGGATGCCAT CTGCACCCAC CACCCTGACC CCAAAAGCCC
19701 TAGGCTGGAC AGAGAGCAGC TGTATTGGGA GCTGAGCCAG CTGACCCACA
19751 ATATCACTGA GCTGGGCCCC TATGCCCTGG ACAACGACAG CCTCTTTGTC
19801 AATGGTGAGC AATTGTGATG TGGTTGGAGT TTCTTCTTCC TTGCTGAGCA
19851 GGCCTCTACT CTCTGTCTTG AGGTCACTCT CCCTGCCTGG CCACTGGTCT
19901 TGGCCATGTT GTCTGTATTT GATGATTGAT ATGAACTTCA CCGTTTCTTC
19951 TTCATCTTGT ACTGGAGACC TTCATCCTCA GGACCTTCTT CCCTGATCTG
20001 AGTGTACTTG TATAGAATCC TCAAAGCCCA TGTTCCCTGA AACTCCTTCA
20051 ATTGCACCAT GGTAGCACTG ACCCCTTTTG GTCCCCCACC TTNNNNNNNN

Exon R4

20101 NNNNNNNNNN NNNNNNNNNN NNNNNNNNNN NNNNNNNNNN TTCACTCATC
20151 GGAGCTCTGT GTCCACCACC AGCACTNNNN NNNNNNNNNN NNNNNNNNNN
20201 NNNNNNNNNN NNNNNNNNNN NNNNNNNNNN NNNNNNNNNN NNNNNNNNNN
20251 NNNNNNNNNN NNNNNNNNNN NNNNNNNNNN NNNNNNNNNN NNNNNNNNNN
20301 NNNNNNNNNN NNNNNNNNNN NNNNNNNNNN NNNNNNNNNN NNNNNNNNNN

Exon R5

20351 NNNNNNNNNN NNNNNNNNNN NNNNNNNNNN NNNNNNCCTG GGACCCCCAC
20401 AGTGTATCTG GGAGCATCTA AGACTCCAGC CTCGATATTT GGCCCTTCAN
20451 NNNNNNNNNN NNNNNNNNNN NNNNNNNNNN NNNGACTCCA GCCTCGATAT
20501 TTGGCCCTTC AGGTAAGTAC CAGTCAATGG CACCTCTATT AGAGTATGCA

TABLE 28-continued

| Genomic Repeats (SEQ ID NO: 312) | |
|---|---|
| 20551 | TGATGAGTGT CAACATCTCT GTCCTTTTCA CTCAAATAAG ATTAAAAATC |
| 20601 | ATAGCAAATT GTACGTGATG ATGAGTCACC CAACAAACTT CTTTGAGTAC |
| 20651 | CCACTCTCTG CCAGGCCCTA GAGATAAGGC AGGGAACACA AAAGAGGTAA |
| 20701 | AAATCTCTGC CCTCAGAGAG CTTCTTTTAT TTTGAGGATG ATGTGGGATA |
| 20751 | GTGGTGATGA TGATGTTGCT GGAGATGATT ACAATAATGA TGGTGATGCT |
| 20801 | TATGACCATG ATGTGATGAT GATGGTGATT ATGAAGATGA TGATGATGAT |
| 20851 | ATTGATGATG GTAGTGGTTT TGACAGTAAT GATGATGTGA TGATGATGAT |
| 20901 | GATAGTGGTG GTGGTGATTA TGGGAAGGAT GACAGTGGTG GTGGTGATGG |
| 20951 | TGGTGGTTGT GGTGGTGATT GACAATGTGG TGGTGATATT GACAATGAGG |
| 21001 | ATGATGATGA TAGTGGTGGT GGTTATGATG GTTAAGGATG ATGTGATGAT |
| 21051 | GGTGTTGGTG ATCACGGTAC TAGTGGTGGT GATGTGGACC GTCATGGTTG |
| 21101 | TGGTTGTGGT GGTGATGGTG GTGATCATGA TGATAATGAG GATGATGGTG |
| 21151 | GTGATTGTCA TGATGGTAAG GATGAAACAG TGATGGTGTT GGTGACCATG |
| 21201 | TTCCTGGTGG TGATGGTGCA GGTGATGATG TGGATGATGA TGGTGATGGT |
| 21251 | GGTGGAGATG ATAGGGATTA TGAATATGGT TCGGGTCTCT GACTGGTGGT |
| 21301 | GGTGATGACA ATAATGAAAA TGATGGTCAC AGTGTTGGTG ATGATGATGG |
| 21351 | TGGTGATAAC AAAGGTAATA GATAGTGTCT AGTATTATGG AACACAGAAC |
| 21401 | ATCACCAAAG GTTATGCTCA GCATCTAACT ATTATTATTT AGCATGCTCT |
| 21451 | ATGAAAAACT TTGATCGTTA TAGTCAAGGG AGGCATGAAA ACCTTCTATT |
| 21501 | TTATCACTCT CTTTAAATCT GGTTGCATAT GTTTAGAAAT AAATCTATTA |
| 21551 | CAAACTCTTA AATGTTCTCT ACTTTTGAAC ATAGTGTTTA TTTCCCACCT |

| Exon R1 | |
|---|---|
| 21601 | CCACTACA<u>GC TGCCAGCCAT CTCCTGATAC TATTCACCCT CAACTTCACC</u> |
| 21651 | <u>ATCACTAACC TGCGGTATGA GGAGAACATG TGGCCTGGCT CCAGGAAGTT</u> |
| 21701 | <u>CAACACTACA GAGAGGGTCC TTCAGGGCCT G</u>GTGAGAGCC CTGCCCACCT |
| 21751 | CACTCTGCCC TGCCCACCTT GTCTTGTTCC ACCTACGTCA CCCATTCCAA |
| 21801 | GGCATGGAAG AAGATCTCAC CCACCTCCCC TCACCTGAGA GATAGCCCCG |
| 21851 | CCCCCTGATT ACAGCCCCTT CCACCTTACA TCTTCCTCAC TTCTATGTCC |

| Exon R2 | |
|---|---|
| 21901 | TCAGCCATCT TACTCACCTC CCTCTTCCTC CTCCACAGG<u>C TAAGGCCCTT</u> |
| 21951 | <u>GTTCAAGAAC ACCAGTGTTG GCCCTCTGTA CTCTGGCTGC AGGCTGACCT</u> |
| 22001 | <u>TGCTCAGG</u>TG AGAACTGAGA ATAACCAGTC TGGCTACCCC AAGTGTTCCC |
| 22051 | AGGCCCAAGG AGTTTCATCA GCTTTCTTCC TTCCCTCCCT ATGGAAGTCC |
| 22101 | TCAGCACAAG TGGAATTCAG GCGTTGGTGG CTCCAGGATG AACATATCTG |
| 22151 | CTGATCCTAC CACCTCCCCC ATCAATCGAG AGAATTTGCA GGGCCCATCA |
| 22201 | GCCAGATCAG GCTTCTACTT TGGTCATCCT TCTGAATTTC TTACTTCTCC |
| 22251 | CTACCTCCCT CTCCTTCAGG TGTTAAATTC TCTTCCAAGG TTTCTCTCAA |
| 22301 | GATAAACATC CCCCATCCAC TTGCTTTCAT CCCCAATTCC AGCTCTTAAT |
| 22351 | ATTTCTCAAG TCTGGGCTCT CCTGTCCCCA TACCATGAGA ATGCAATTTT |

TABLE 28-continued

Genomic Repeats
(SEQ ID NO: 312)

```
22401   ATAAAATTCT TGTATTCCTG ACTCTACTCA CATTCCCAGG CTGCCTGGAA
22451   GTTGGTGCAT TCAGAGAATC TTAGTATGGC TTCTCACCTG TCTACCAGGA
22501   TTCTCATTTC CTCTGTCCCC TTCCTGTCCT GCCCCAGGA ATCTCAGGAT
22551   GCCTCCCCAT AGGCAATCTA TTTAATGTCA TCCCCCTTAT CTGCCCTCCC
```

Exon R3

```
22601   TAGGCCAGAG AAAGATGGGG AAGCCACCGG AGTGGATGCC ATCTGCACCC
22651   ACCGCCCTGA CCCCACAGGC CCTGGGCTGG ACAGAGAGCA GCTGTATTTG
22701   GAGCTGAGCC AGCTGACCCA CAGCATCACT GAGCTGGGCC CCTACACACT
22751   GGACAGGGAC AGTCTCTATG TCAATGGTGA GCGGCTGTGA TGTGGTTGGA
22801   GATTCTTCCT CTTTGCTGGA CAGCTTCTTA CTCTCTGACT TGAGGTCACA
22851   CTCCCTGACT GGCCATTGAC GTCTTGGCTA TGTTGTCTGT ATGTGATGAC
22901   TGATGTCTGA ACTTCATAGT TTCTTCATCT TGGACTGAGT TCATCCTCAG
22951   TACCTTCTTC CCTGATCTGA GGGTACTGAT AGAGAATCTT CAAAGGCCCC
23001   TGTTCCTTGA AACTTCTTCC ATTCCACTAG GGTATCTGTG ACCCCTATTT
23051   GATTCCCCAC CTCTCCCTTA ACCCTTACCC ACTCTCCTCC CTCCTTCTCT
```

Exon R4

```
23101   GTGCAGGTTT CACCCATCGG AGCTCTGTAC CCACCACCAG CAGTGAGTAT
23151   TCAACCGATG CTCCAGTAGC CCCAATTATA CACCAAGCAG GGCAGGAGCT
23201   GTCCTGTCTT CCTATGCCCC TATGTCCTCT TCATAAAGGA AGGGGCTGGG
23251   AGGGCACAAG TTATTCCCTT TCCCTTCTGG CCAGCTCCAG AGAGAGACCC
23301   AGCTCAGGCC CGATATGCAG CAAGGCCTGT AAATAGTTTT ATTTGCTGAC
23351   CTTTCTGCCA TGAGAGGCTT GGATGCTTCC CCTGAAGAGG GTTTCTCTGT
23401   AGCTCTTGGG ACTACCACAG TGGACCTGGG AAACTCTGGG GATCCACCCC
23451   TTCTACTGGT CCCTTGAATA AGTACCAGCC AATGGCACCT CTGTTAGAGC
23501   ATGGCTGATG AGTGTAAACA TCTCTTCCAT TATTCAGTCA AATAAAGATG
23551   GAAATTCTTT ATAAATCTAG TGATGATGAG CCAACCAACA AACTTTATTG
23601   AGCATTGTGA CAAGCCCTGG GGCTCTGCCA AATCCTGGGG ATATGGCATG
23651   GATCATGAAA CAATTAATAA TCTCTCCTCT CAGAGAGCTA TTTTTATGAT
23701   GATACTGATG GTGGCAATGA TGATGATGTT GATGGTGATT ATGACCATGA
23751   TGACAATGGT GATGGTGGTG GTGATGATGG TAATGATGAT GATGGTGATG
23801   TTGGTAATGA TGGTGGTGAT TATGACAATA ATGATGGTGA TGGTGACAGG
23851   GATGGTGATG ATTATGATGG TGGTGGTGAT AACAAAGTTA ATGGATAATA
23901   TATGAACTTA TTGGCTACTG AATATGCACC AAAGTGCTAT GCTCAGTGTT
23951   TAACTAGTAC TATTTAATAT GATTTCTAAA AAAAATCTTG AATTATTATA
24001   GGCAGAAGAA TCATGGGAAC CTTTTATTTT GTCACTCACT TTAAGTCCTA
24051   TTGCATATTT TTTAAGTCAA TTGCAAACAC AGTTTCTCTG CTTTGAACAT
24101   TGTGTTTATA TCCAGTCACC CCAATAGTGC ATAAACCTGC TGATTGGAGC
24151   AACTGTGTCT TACTCCCTTG TGCTTCCCTA GTATCTGCTT CAGGACCTTG
```

TABLE 28-continued

Genomic Repeats
(SEQ ID NO: 312)

| | |
|---|---|
| 24201 | TACATGGTAG ATCGACAGAT TTAGATCTAC AGGAAAATAT GGATTTTCCC |
| 24251 | AGGGAAGGAA GGAATGAAGT ATGCTTTCTT ATAATGTATG GAAACTTTCC |
| 24301 | TCTTCTGCCT TGGTTCAACT TTAGTGTCTG CCAGAGTTTA CACTGGAAAA |
| 24351 | CTATATGGCA TCTGCTCCAC TCCCTCATCC ATGACAGACA TCATTAATTG |
| 24401 | ATTGCAGCAT TCATGGCAGA CATCACCAAT TGATAATAGC ATTCATTTTC |
| 24451 | TCTCAGTTCA AAACAGCTTC AGAATGGTTA CCAAAAAAAA AAAATTCAGT |
| 24501 | CGCTACCAAT TCAATTGGAG CTGACTCAGG ATTATGGGAC AGAATTCAAG |
| 24551 | AGAGTTAGGT TCCTTGATGA TGTGTAGTGG CTATTTGTTT TCCGGTCCAG |
| 24601 | GCTAATNNNN NNNNNNNNNN NNNNNNNNNN NNNNNNNNNN NNNNNNNNNN |
| 24651 | NNNNNNNNNN NNNNNNNNNN NNNNNNNNNN NNNNNNNNNN NNNNNNNNNN |
| 24701 | CTTTGTGCGG CAAAGTTCAG GGGCCCCAAA AATTTCTGTG CCCCAATCAT |
| 24751 | GGCGGACCTA GGTTTAGGCA CAAATTCCAG GGATTAAGTC CCTGGAGATG |
| 24801 | TTATGGCTTT TGGTTTTCCT AGAAAGGCTC AGCTCAGGCT CAGCTTGGTC |
| 24851 | ATGCTGATAT CCTTTCTTCC ACTTGGTCGA TTTGGCTGTT GATACTTATG |
| 24901 | TATGCTTCAC GAAGTTTTTG TGCTGTGTTT TTCAGCTCCA TCGGTTGGTT |
| 24951 | TATGTTCCTC TCTAAACTGG TTATTCTAGT TAGCAATTCC TTTAACCTTT |
| 25001 | CATCAAGGTG CTTAGCTTTG CATTGCATTA GAACATGCTC CTTTAGCTCA |
| 25051 | TCGTACTTTT TTATTGCCCA TCTTCTGAAG CCTACTTCTG TCAATTCATC |
| 25101 | CATCTGATCC TCCATCCAGT TCTGCACCCT TAATGGAGAG ATGTTGCGGT |
| 25151 | CATTTGGAGG AAAAGAGGCA CTCTGGCCTT TGGGTTTTC AGCATTTTTT |
| 25201 | TGTTGATTAT TTCCCATCTT CAGGAGTTTT AGTTTCAGGC TTTGAGGCTG |
| 25251 | CTGATCCTTG GATGGGGTTT TTATGGGGGT CTTTTGGTTG TTGTTGTTGA |
| 25301 | TGATGATGAT GTTATTGTCA CTTTCTGCTT GTTTTTCTTT CAATAGTCAG |
| 25351 | GTCCCTCTTC TGTAGGGCTG CTGCAGTTTG CTAGGGGTTC ACTTCAGGCC |
| 25401 | CTATTCATCT GATTCGCTCC CATGTCTGGA GGTGTCACTC AAGGAGGCTT |
| 25451 | GGAGAGCAGC GAACATAGGT GCCTGCTTCT TCTGGGACCT CTGACCTCGA |
| 25501 | GGGACACCAA CCTGATGCCA GTAGGATCGC TCCTGTGTAG GGTGTCTGAC |
| 25551 | AACTATTGTT GGAGGGTTTC GCCCAGTTGA CTGGCATGGA GAGCAGGACC |
| 25601 | CATTTAATGA AGCACTTTGT CCCCTGGTGG AGAGGGGGTT CTTCACTGGG |
| 25651 | GGGAAACCAC ATGTCTGGGC TGCTTGGATT CCTCAGAACT ACCAGAGGAG |
| 25701 | AGGCTAAGTC TGCTGGTCCA CAGAGACTAC AGCCATCCCT CCCACTAGGG |
| 25751 | GCCCAAGCCC AGGGAGTCCA AATTCTGTCT CTGAGCCTCT GGCTGGAGTC |
| 25801 | TTTGGAGATC CTGCAAGGAA GCTCTGCCCA CTGAGGAAGG ATGGGTCAGG |
| 25851 | GTTAGCCCTG AAGAGGCACT CTGGCTGCAG ACTGCCACAG CCGGTGTGTT |
| 25901 | GGGCTGTGGG GACAAGTCTT GGGACCAAGC CGTCCAGCCT ACCCGGCTCT |
| 25951 | AGCAGGGGAA AAGTACAGCC TGGAGCTATT GAAGGGGTG CCGCCCTTCC |
| 26001 | CCCGCCCAGG GAGCTTAGCG TGTTAGGCAG TTGTGAGTCC AGTGCTGGCT |
| 26051 | GTCGCCCCTT CCCCAAGGAA CAAAAAAGAC TTAGCAGGCA GCCGCAGCCA |
| 26101 | GTGCTGGTCG CCCCTCCCCC GGGGAGTTCC GTAGGCTTAG GCAGATTCCA |

TABLE 28-continued

Genomic Repeats
(SEQ ID NO: 312)

```
26151   GCTGTAAGAA TCTGCGTGTT CTGGGGTTGG GACACTAGGT CCCAGTGGCA
26201   TGGGTTCGCG AGTGAGATCT TCCAATCTGT GAGTTGCACA GTTCCGTGGA
26251   AAAAGCACAG TTTCCCCCTC TTGGGTAGCC CGCTCACTCA CCACCTCCCT
26301   TGGCTGGAAG GAGGGGGTTC CCCTTCCCCG TGTGTCTCTC AGGTGGGCCA
26351   CCACACCACA CTGCTCTTCC TTCTCTCTGT GGGTCACTGC CAGCCTTCTA
26401   GTCAATTTTG ATGAGGGAAC CTGGACATTT TGGTTGCCAG GAAGGATCAC
26451   ACACTTATTA CAGTTTTTTT CAATGTGAGC CTCTGAGCGC TGCTGCTTAT
26501   AGTCGACCAT CTTGGCCCCC AGAGTCACAC ATCTGTTATT TTTTGATGTT
26551   TTGATTGTGG CAATTCTTGC AGAAGTAAGG TGGTATCACC TTATGGTTTT
26601   GATTTCCCTG GTCATTAGTG ATGTTGAACA TTTTTTTCAT ATGTTCATTA
26651   GCCATTTGTA TATATTCTTT CAACAACTGT CTATTTATGT CCTTAGCCCA
26701   CTTTTTGATG GGATTGTTTT TTTCTTGCCA ATTTGTTTGA GTTCGTTGTA
26751   GATTCTAGAT ATTAGTCCTT TGTTGGATAT ATAGATTGTG AAGATTTTCT
26801   CCCACTCTGT GGGTTGTCTG TTTACTCTAC TGACTGTGAA GGAAAAGTCA
26851   ATTTCTTATA CGAATTTGTC TCACTCCTAC TTCCAAATGA GATCCTGGGG
26901   TTTTTTTTTT CTGTTAATCC TTCACAATAC TTCTCCCACT TTTTGAACT
26951   CATTTGTTTA TATTCTGTTG TCTGCTTCTC TTTTATAGGA ATGTGACTTC
27001   TTATGGGCTT TCTCTATTAT ACCACATATG GGTTTTTGTT TTGTTTTGTT
27051   TTGTTTTGTT TTGTTTTTGT CCTCGGATCC ATTCTCCAAC CTCCTCCAGC
27101   CTTCCCGTGC TCTGTGGGAT AGACGTCTGA CTCATGAAAA CTACATTTCC
27151   CAGGCTCCCA TGCTAACTAG CTTCCTGTTA GGTTCAGCCA ATAGGAGGCA
27201   TTGGTGGGAC AATGGTGGGC GGGGCTATGG AAGGGCCAGA GTATTTCTGT
27251   ACCCCGCCCC CCTGCTCCCC TTCCAATGTT CCTGGAGCGG TGTAGGACCA
27301   ATACTGTATA TATGGAAGGA AGGCAAGGTG GATAGATTGG AAGGAAGAAG
27351   TGACAGATGG AAAGAAGAAG TGATAAATGG CAAGCGAGGC AAGGGAGCAG
27401   AGGATGGATG AGTGGATTGC AAGAAAGAAA AAAATGGATG AAATATAAAA
27451   GGAGCAGGAC AGATGGATAA GTAGATGGAA GTAAGAAAAG ACTGGTGTAA
27501   GAAAGGAACG ATTGATGATG GATGATGAAT GGATCAGTGG TGATTGGGTG
27551   AAGGGATGAA TGGATGGATG GACAGATGGA TGAACAGATG GGTGGGTGGA
27601   TAGATGGATG GATGGATAAA ATGGGTAGGT GGATGGATGG ATGGATGGAC
27651   AGATGGGTGG GTAGGTGGAT GGATGGATAG ATGGATGGAT AAGTGAATGG
27701   ATGGATGGAT GGATGGATGG ATAAATGGAT GGATGGGTGA AAGGAAGGAA
27751   AGAAGTGAGA GAAGGAAGAG GAAGGATAGA CAGATGTTAG AAGGTACAAA
27801   TGAAAGGAAG GAAGCCAGCA AGAAAGAAAG GATGCATTAA TAGAATGAAA
27851   GATGGAAGGG AAGAAGAAAG GATGGAAAGA GAGAAGGAAG AATGAACAGA
27901   AGGAAGTTCA AGAGTGGTGA AAAGAAGAAA GGCAGGGAGA GAAGGAGAAG
27951   TAAACTTTTC TTCTAGAGAT TTGTCTTAAA CCTTAGCTTG GCTGGACACT
28001   GTGGTTCACG CCTGTAATCC CAGCACTTTG GGAGGCCGAG GCGGGTGGAT
```

TABLE 28-continued

Genomic Repeats
(SEQ ID NO: 312)

| | |
|---|---|
| 28051 | CATGAGGTCA GGAGATCAAG ACCATCCTGG CTAACACGGT GAAACCCTGT |
| 28101 | CTCTACTAAA AATACAAAAA AAATTTAGTC AGGTGTGGTG GTGCATGCCT |
| 28151 | GTGGTCCCAG CTACTCAGGA GGCTGAGGCA GGAGAATGGC ATAAAACCTG |
| 28201 | GGAGGCAGAG CTTGCAGTGA GCCAAGATCA CACCACTGCA CTCTAGCCTG |
| 28251 | GGCGACAAAG TGAGACTCTG TCTCAAACAA AAACAAAACA AAAAACAAA |
| 28301 | AACAAAAAAC AAAACCAAAC CAAAACAAAA AAAAAAACCT TAACTCATAC |
| 28351 | TTTCATAAAG TTCCACACAC AGGGAGTGAT TAGAAAGCAT TTGCTGATAT |
| 28401 | ATTTTATATA ATAAACATGT ACACCATATT GACCTGTGTG CCCAGCAGTG |
| 28451 | CTTACATGAT TTACAATGAT TAACTTGTTT AAGCTTCATA ACAACGGTTG |
| 28501 | AGGCAGGAAA CATCATTGTG AACCATTGTC ATCTCATTTT ACAGATGAGT |
| 28551 | AAACTGAAGT GCTGAGAGGT TGGTTATGGC TGCAAAGATT GTTGGCCATG |
| 28601 | TTAACCAATG CATAGAAGAT TAGCATACCT GGTTGTGAGT GCAGGAGAGA |
| 28651 | GAGAGAAATG GGAGAAAGGC AGAGAAGGAT CGATGGGGAG AGAGGAAGAG |
| 28701 | AGAGAGAGAG AATAAATTTT TTAAAAATGT CTAGAGTCAT GACTTCCGCA |
| 28751 | TCAGTGTGGT AATATGCAGC CTTTACCCTG GGAAAGATCA GAACCATTGG |
| 28801 | TACTTTTTAC AGAATCTTCC CTTCCTGCAT TTGGGTAGAA GGACCCCATC |
| 28851 | TGGACATCCC AAATCATTAA GCACACCCTT ACTGGCTGCT GGAGTTGTCT |
| 28901 | CCATTAAAAG TCACCGTTGG GTTTATTAAG AGGCGGACAC AGGGTCCTTA |
| 28951 | GAACACACTG CCCCCACCTG TCCCACACCA CCCCCCACCC ACCCATCATC |

Exon R1

| | |
|---|---|
| 29001 | CTCCCCAAGA GCTTCATCTC TCTCTCTCTT CCCCCTGCCC TAGCC<u>GGGGT</u> |
| 29051 | <u>GGTCAGCGAG GAGCCATTCA CACTGAACTT CACCATCAAC AACCTGCGCT</u> |
| 29101 | <u>ACATGGCGGA CATGGGCCAA CCCGGCTCCC TCAAGTTCAA CATCACAGAC</u> |
| 29151 | <u>AACGTCATGC AGCACCTGGT</u> GAGAGGCCTG CCTCCCGCTG CAGCCCTGCC |
| 29201 | ATGCCCATCC TAGGGCTGTT GCCTGCCTGC CTCTGACCAA CCCAAGCTCC |

Exon R2

| | |
|---|---|
| 29251 | CTTCTCCCTC TGCAG<u>CTCAG TCCTTTGTTC CAGAGGAGCA GCCTGGGTGC</u> |
| 29301 | <u>ACGGTACACA GGCTGCAGGG TCATCGCACT AAG</u>GTGAGAA ACTCCCCCAC |
| 29351 | CCACAGCGCA CCACCAAGAA CTTAGAGTTC TGACTGGGAG GTCCCTCTTG |
| 29401 | GGTTGGGGTG GGCTACATAT TTTTTTAAAT CTTTTTATCT TTCCTTTTTT |
| 29451 | TTTTTTTGAG ATGAAGTTTC GCTCTCGTTG CCCAGGCTAG AGTGCAATGG |
| 29501 | CACGATCTTG GCTCACTGCA ACCTCTGCCT CCCGGGTTCA AGTGATTATC |
| 29551 | CTGCCTCAGC CTCCCCAGTA GCTGGGATTA CAGGCAGGCA CCACCATGCC |
| 29601 | TGGCTAATTG TTTTGTATTT TTAGTAGAGA TGGGGTGTCT CCATGTTGAT |
| 29651 | CAGGCTGGTC TTGAACTCCT GACTTCAGGT GATCCACCCT CCTCAGCCTC |
| 29701 | CCAAAGTGCT GGGATTACAG GCGTGAGCCA CCATATCTGG CCCCATTCTT |
| 29751 | TTTTTTTAAA TGAATTTAAG GAGTGCAAAT GCAGTTTTTG TTACATGCAT |
| 29801 | ATATTCCATA GTGAAGTCTG CAGACAGTAG ACTTCCAGAC AGTAGCTTCT |
| 29851 | GGTGTATCAC CCGAATAGTG TACATTGTAC TTATTAAGTG AGGTTCCCCA |

TABLE 28-continued

Genomic Repeats
(SEQ ID NO: 312)

```
29901  CCCTTCTCCC ACTCTCCCAC CTTTCTGAGT ATCCAGTGTC TATTATTCCA
29951  CACTCCAGGT CCATGCTCTC ACGTATAAGT GAGAACGTAT GGTATTCCAC
30001  CATGAGCTAA TGGACATGGA GTCCATTGGC TCCCACTTAT AAGTGAGAGC
30051  ATGCGGTATT TGACTATTTC TGAGTTTCAC TTAAGATAAT GGACTCCCAT
30101  TCCATCCATG TTGCTGCAAA ATACATGATT TCACTCTTTT TATGGCTGAA
30151  TAGTATTTCG TGGTATATAT ATATACCACA TTTTCTTTAT CCAGTCTTCT
30201  ACTGATGGAC ACTTAGGTTG GGTCCATACC TTTGCTGTTG AAATAGTGCT
30251  GCAATAAACA TACACGTGCA GGTGTCTTTC TTATATAAAT GATTTCTTTT
30301  TTTCTTTCCT TTTTTTTGAT ATAACGAATT TCTTTTATTT GGGTTAAATC
30351  CCCCAATAGT GGGATTGNNN NNNNNNNNNN NNNNNNNNNN NNNNNNNNNN
30401  NNNNNNNNNN NNNNNNNNNN NNNNNNNNNN NNNNNNNNNN NNNNNNNNNN
30451  TGACCTGTCC GTATTGATAT ATAAAATGCT GCATTTAAAG TGTACAACTT
30501  GATATTTTGG TATACATTGT TAAATCATGG CCACATTTCA GCTAATTAAT
30551  ATATCTATTA TCTCTACATA GTTATCATGT TTGTACCCTT TGACCAGCAT
30601  CACCCCATTT GCTCCTCCTC CCAGCCCCTG GCAACCACCA TCCTACTCTC
30651  TGCTTCTATG AGTCTGACAA TTTTAGATTC CACCTATAAG TTAGATTATG
30701  CGGTATTTGT CTTTCTGTGC CTGGCTTATT TCACTTAGCC TAATGTCCTC
30751  CAGCTCCATC TATGTTATCC CAAGTGGCAG GATTTTCATC TTTCTTATAT
30801  ATTTCATTGT ATATGTGTAT GCCACATTTT CTTTACCCAT TCATCCATTG
30851  AAGGTCATTT AGCTTGTTTC CATATCTTGG CTATTTTGAA TAGTGCTGCA
30901  ATGAACATAG GAGTGCAGAT ATCTCTTTAA GATACTGGTT TCATTTCTTT
30951  CTTTCTTCTC TTTTTTTTTT TTCTGAGACA GAGTCTGACT CTGTCGCTCA
31001  AGCTGGAGTA CAGTGGTGCA ATCTTGGCTC ACTGCAAACT CTGCCTCCTG
31051  AGTTCAAGCG ATTCTCGTGC CTCAACCTCC CAGGGAGTTT TGCTCTTGCT
31101  GCCCAGGCTG AAGTGCAGTG GTGCAATCTT CACTCACCAC AACCTGTGCC
31151  TCCCGGGTTC AAGCGATTCT CGTGCCTCAG CCTCCCAGGT AGCAAGGATT
31201  ACAGGCGCCC AACACCACAC CAGGCTAAAT TTTTTTGCAT TTTTAGTAGA
31251  GACGGGGTTT TGCCATGTTG GCCAGGCTGG TCTCAAATTC CTGGCCTCAA
31301  GTGATCCACC TGCCTCAGCC TCCTGAAGTG CTGGGATTTT ACAGGCATGA
31351  ACCACCACAC ATGGCCTCAT TTCTTTTAGA TATATATGGG TTGAGCTATT
31401  CTCAGAGGGT CCTTTTCTGC ATCTATTTAA GATCACATTT TTTTTATATT
31451  GTGGCAAAAA TACATGTAAC ATAAAATCTG CCATTTTAAC CATTTTTAAA
31501  TGTACAATTC AGTGACATTG ATTATATTCA CAATGTCATA CAGCCATCAC
31551  CACTATTTAT TTCTAATACT TTTCCATTGG GTAGATCCCC AACAGTGGGA
31601  TTGCTGGGTC AAATGGTAGT TCTGATTTTT TTTTTTGTT TTTTGAGAAA
31651  TCTCCATACT GTTTTTCATT TGAGGTTGTA CTAATTTACA TTCCCACCAA
31701  CAGTGTATAA GAGTTTCCTA GGCCGGGCAT GGTGGCTTAT GCCTGTAATC
31751  CCAGCACTTT GCGAGGCCCA GGTGGGTGGA TCATGAGGTC AGGAGATCGA
```

TABLE 28-continued

Genomic Repeats
(SEQ ID NO: 312)

```
31801   GACCACCCTG GCTAACATGG TGAAACCCCG TCTCTACTAA AAATGCAAAA
31851   AATTAGCCGG GCGTGGTGGC GGGTGCCTGT AGTCCCAGCT ACTGGAGAGG
31901   CTGAGGCAGG AGAATGGCAT GAACCCTGAA GGCGGGGCTT GCAGTGAGCT
31951   GAGATCGCAC CACTGCACAC TTCAACCTAG GCGACAGAGC GAGACTCCAT
32001   CTCAAAAAAA AAAAAAAAAA AAAGGTTTC CTTTCAGTGC ATCCTTGCCA
32051   ACTTGAGTTT TCTGGGTTGG TTTGCACTCT CATGGTATTT ACTAGATACT
32101   TCTCCATTTA TATTTTTACT CAACCCATGC CCATAACACC ACTCCTCTAC
32151   CATTCCCACC AACCATGTAT AAGAGTTCCT TTTCTTGCAT CCTTGCCAAC
32201   TTGACTTCTT TGGGTCAGTT TGCACTCTCT TGGTATTTAC TATTTACTTC
32251   TCCATTTATA TTTTTAGTCA ACTGATGCCC ATGGCACCGC TCCTCTGAGG
32301   CAGGTGCTGG GTACTAGAGT GATAAGACAG ATGCTGTCCC TGCCCTCACC
32351   CAGTGGAGAA GAACAGATGC TAAACAGGAA CATAAATATC TAAGTAAAAT
32401   GGCTTCAAAT GGAGTAAAGT GATATGAAAC ATAAATAAAT AGCAAGTGAT
32451   GGGTAGAGCA ACTTTACCCA GGATGAATCT TGGGCTGTGT CCCAAATGGC
32501   CATGAAAACT GTTCCAGGCA GGGAGAACAG CATGAGAAAA GGTCTTGAGG
32551   TGCAAATGAG CTTGGCATGT TCTATGAACA GCAAAGAGGC CAGTGTGGCT
32601   GGAGCAGAGA GAGAGCAAGA AGAAAAGAGA GAAAGGATGA GACTCAAGAC
32651   ATCAGCAAGT TTGAAGGGCC TTGGAGGACT TGGATTTTTT TTTTTAAGAC
32701   AGCTTTGTTC TTGTTGCCCA GGCATGATCT CGGCTCACCA CAACCTCCGC
32751   CTCCTGGGTT CAAACGATTC CTCTGCCTCA GCCTCCCGAG TAGCTGGGGG
32801   TAACAGGCAT GTGCCCACCA CACCTGGCTA ATTTTGTATT TTTAGTAGAA
32851   ATGGGGCTTC TCCATGGTTG GTCAGGCTGG TCTCGAACTC CCGACCTCAG
32901   GTGATCCGAC CGCCTCGGCC TCCCAAAGTG CTGGGATTAT AGGTGTGAGC
32951   CACTGCACCT GGCTTGGATT TTTTTTGTTC TATATTGTGG TAACATACAC
33001   ATCACATTAA ATTGATCATT TTAGCTATAT TTCCCGTTCA GTGGCATCAA
33051   GCACATTCAC ATTATTGTGC AACCATCACC ACTATCATCC ATCTCCAGAA
33101   CTTTCTCATC TTCCCAAACT GAAACTCCAT CCCCATGAAA CACTCATTCC
33151   TCATCCCCCT CCTCAAGCCT CTGGCACCCA CCATTCTACT TTCTGTCTCT
33201   GTGAATCTGA TGATTCTGAG GACCTCCTAT GAATGGAGGA ATCATATGGT
33251   ATATGTCCTG GTTTATACTG TATGGCTGGC TTATTTCACC AAGCATAATG
33301   TCCTCAAAGT TCATCCATGT TGTAGCATGT GTCAGAATTC CCTTCCTTTT
33351   CCACTTGTAT GTAAATGCTG TATTGTGTTT CTCCATTCAT TAGGACTTTG
33401   ATTTTTGCAG GGAGTTGTCA AGGGGTGCTG GGTTCTGGGG CTTCAATATA
33451   ATAAGAGTAA GCTAAACTGG TTCATTTCCT CCTTCGTGGA GACCATGTTC
33501   TGGTAGGAAC AGGAACAAAT AATTTATGAT TACATAGAGG GTGACCAGGG
33551   CAGTGACAGG GGAAGAGTGG AGGATTGTGG GACCCAGAGG AGGCTCCTGA
33601   CCTTGCCTAG GAAGATAGGA GGAGGAAGAG GAGGAGGAAG AGGAGGAGGA
33651   AGAGGAGGAG GAGGAGGAGG AGGGAGTCCT CTAAGCTGAG ACCTGGAGGA
33701   TGACCAGGAA GTTATCCAGG TAAGGAGAAA TGGGGAGAAG CTTCCAGACA
```

TABLE 28-continued

Genomic Repeats
(SEQ ID NO: 312)

| | |
|---|---|
| 33751 | AAAGTAACAG CAATTGCAAA GATCCTGAGA TGATAGATAA GGTCAGGTGG |
| 33801 | AGAAAGTGCA AACTGTCAAT GAGACCAAAA TATGGACTGT GAGTTGTGCA |
| 33851 | GTGACCACAA GTGGAGAGGT GCTAGGTGGC CTTCATCCCC CAAAGCTGCA |

Exon R3

| | |
|---|---|
| 33901 | CCTCTCCCTC CTCAGG<u>TCTG TGAAGAACGG TGCTGAGACA CGGGTGGACC</u> |
| 33951 | <u>TCCTCTGCAC CTACCTGCAG CCCCTCAGCG GCCCAGGTCT GCCTATCAAG</u> |
| 34001 | <u>CAGGTGTTCC ATGAGCTGAG CCAGCAGACC CATGGCATCA CCCGGCTGGG</u> |
| 34051 | <u>CCCCTACTCT CTGGACAAAG ACAGCCTCTA CCTTAACGGT</u> GAGCAGCTAT |
| 34101 | CAGCCCCATC TCCCTGCCCC ACCCCCAGC CCCCACTGCA GTCCAGGAGG |
| 34151 | GTGTCTGTTT GCCGGTTCTC TAGGGAAAGA CTTGGGGTTC AAGTCTTGGC |
| 34201 | ATTACCACTG GCCCTCCCAT AACCACAATG CAAGGTTGGA CTTTGATTAA |
| 34251 | TCCCATTTTA CAGATGAAGA AACTGAGGCT TAGACAGGCT AAGCAATTTA |
| 34301 | CCTTGACAGT GGTGGAACCA GGATATGAAC TCCACTTGTC AGCATTCGGT |
| 34351 | GCTATGATCC ACTCCACATG TTTAACTCAC AGAAGAGTCT TCCTGGTGGG |
| 34401 | GGCACTTGGG GGACAAAAAA CACATTTCCG GCTGTGAGCA GTGGCTCACA |
| 34451 | CCTGTAATCC CAGCACTTTG GGAGGCCAAG GCGGGCGGAT CACAAGGTCA |
| 34501 | AGAGATTGAG ACCACCCTGG ACAACATAGT GAAACCCTGT CTCTACTAAA |
| 34551 | AATACAAAAA TTAGCTGGGT GTGGTGGCGC ACGCCTGTAG TCCCACCTAC |
| 34601 | TCGGGAGGCT GAGGCAGGAG AATCGCTTGA ACTCGGGAGG CAGAGGTTGC |
| 34651 | AGTGAGCCAA GATTGCGCCA TTGCACTCCA GTCTGGGTGA CAAGAGTGAA |
| 34701 | ACTCTGTCTC AAAAAAAAAA AAAACAATTT CCCCTCCCTG CTTTCTTCTC |
| 34751 | ACCATTGACG AGGGATGGGC TTCTCTCCTA CCTGAGGCCC CCTATACCAG |
| 34801 | GAAGATCTAT GGGATCTAAT CTTCAGCGCA CACTGGGCCT CAGCATTGGT |
| 34851 | CTAGAACTCA GGATAAGATA GCATTTAAGA AGGCATCCCC TAAATGGGGT |
| 34901 | TCTGAGAGGC AAAGCATGAC CGTGGGAGAAT TGACAAAATA GCTCGCCTTT |
| 34951 | CATCCCCTCC ACCGCCAACC CAAGAACAGT GCTTATCATC ATGACCCCAT |
| 35001 | GAGGTGGGCA CCCCATATCA CTTATATGAG GTACCTTTAG GTAGGTACCG |
| 35051 | GGATGTGGAG AGACATCCTG GGCTTTCATT ACTCTTATTT TAGCAAAGAG |
| 35101 | GGAATCTGAG GCACAGAGAA GGGAAGGGAC TTGCCCATGC CCACAGCGAG |
| 35151 | TTTTTGGCTA GTATGGGTCT TGATGTTCTT TCTGGGTCCG TNNNNNNNNN |
| 35201 | NNNNNNNNNN NNNNNNNNNN NNNNNNNNNN NNNNNNNNNN NNNNNNNNNN |
| 35251 | NNNNNNNNNT TCCTGCGTGG GAGATGTGTG GATTTGATTT GTATCTGGAA |
| 35301 | AGATGATTTT TTATTGGTGA CAAAGCAGTT AAAGTTAATC TTCACAGTTG |
| 35351 | TGCGGAGAGT GACCACGCGA GTTAGTCTTA TCCTTATTTT TTTGATCATC |
| 35401 | CCGCTACACA AGACAAAGCG AACCGCACAG GCAACATCAG CAGGCCCCAT |
| 35451 | TGGTGTGTTC CCCTCTATGG GTCCATGTGT TCTCATCATT AGCTCCCACG |
| 35501 | TATAAAGTGA GAAGATGGCA GTATTGGTTT TCTGTTCCTG CATTAGTTTG |
| 35551 | GTAAGGATAA TGACCTCCAG CTCCAACCAT GTTCCTGCAA CGGACATGAT |

TABLE 28-continued

| Genomic Repeats (SEQ ID NO: 312) | |
|---|---|
| 35601 | CTCATTCTTT TTTATAGCTG CATAGTATTC CATGGTGTAT ATGTTCCTCA |
| 35651 | TGTTCTTTAT CCAGTCTATC CTTGATGGGC ATTTAAGTAG ATTCCATGTC |
| 35701 | TTTGCTATTG TGAATAGTGC TTCAGTGAAC AGGTGTCTTT ATGATAGAAA |
| 35751 | AATTTATATG CCTTTGGGCA TATATGCAGT GATGAGATTG CTGGGTCAGA |
| 35801 | CGGTAGTTCT GTTTTTAGCT CTTTGAGGAA TCATCCTGCT GCTTTCTACA |
| 35851 | GTGGATGAAC TAATTTACAC TCCCACCAAC AGTGTATAAA CACTCCTTTT |
| 35901 | TATCTGCAAC CTCAGCAGCA TGGTTTTATT TCTCTTTATG GCTGAATAGT |
| 35951 | GTTCCATTGT GCATATATAC CACACTTTCT TTATGGATTC ATCTGCTGAT |
| 36001 | GGACATATAG GTTGATTCCA CATCTCTGCT ATTGTGAATA GTGCTGTGAT |
| 36051 | AAACACACAG GTGCGGGTTG GGTCTTGATG ATCTCAGTTA ACATCCAGTC |
| 36101 | CCTTCAACTT GGCTATTGCA GGGAGCTGTT CCCCCTTGTA AACTGCACAG |
| 36151 | CTTATGTGCT TCATTTTGTT CCTTCATTTA GATTTACCAA GCAGCTACTA |
| 36201 | TTAACCAGGC CACAATGTGC CTCGCCCCCA GGAACAGAGA TAGGTTACAT |
| 36251 | GTGCATCCTG TCCTAATGTA ATCTCCAGGG GGGCGGAGAC TGTTTTGTTC |
| 36301 | TACCCTATAT TCCCCAAATG TAAAGGGAGC CTTGCACATA CTAAGCCCTT |
| 36351 | AATAAACATT CATTGGGTGG AGGAATAGAT TGGAGGAGGC CTGGAAGGGG |
| 36401 | AGGCGGGGGT TATGGATGGA TAGGAGGATA GACTTGTGAA CACAAAGGTA |
| 36451 | GTGAGAGCCT CTCATTGGAG GCATGCTGGA GACGTGAGTA GGGAAGGGTC |
| 36501 | AGTGCTAATT GAAATATCAG GAAATTCTTT CTAGTGGTGA ACACATTTAA |
| 36551 | GTCAAATATT AGATGATACA TAAATGTATC CATAATCTCT AGATACACAA |
| 36601 | AGGGAAAGGC ATCCAGGCAG GGGCCCCATA TGGACAAAGG CATGGAGTAT |
| 36651 | CTGGGACGGT TCCACCACCT CCTCTTACGT GTGACTTCTT TGTTTCAAGG |
| Exon R4 | |
| 36701 | <u>TTACAATGAA CCTGGTCTAG ATGAGCCTCC TACA</u>AGTACG TGTCTTTGAA |
| 36751 | TCTAGTGCCC ATTTCAATCT CCATGGGTCT TGGTTCAAGC TTTTCTCCTC |
| 36801 | ATTCATGAAG GAAGGTTGCC CCAAATTCGG GCTGGTCCCC TAGGTGGTGA |
| 36851 | GGGGCATTGT CTCAGTGGGA GGAAGAATGC TGAGTCCTTG GCCCTGTTTT |
| 36901 | TAGACCTGCA GCCATAGTCT TGGCTTTGTG AATTTTCCAT GTCCCTCTGG |
| 36951 | GTTGGAGGAA GAAGTTTGAA CAAGCATTCC CTACACGGGA TAGAGGTTGA |
| 37001 | GGTCAGATGA TGACCTCTGT TAGTCTGTAC CCTCCTTGAT AAGAAAATCT |
| 37051 | CCTCCAAGTG CCCCAGCAGA GGCTTCATGG TCAAGCTGCA GACTCTGCTG |
| 37101 | GCTACTGGTT TTGGCTAAAT TTGCCCATTG CCTCATCCAG TGATCCACTC |
| 37151 | GTCTATCTTT CCAGCCATCC ATTTTTCTAT CCTTCCAGTC ATCTCTCAGA |
| 37201 | CACCACCTGT CCTTCCATCC ATCCATCCGT CCATCCATTT ACCCATCCAT |
| 37251 | CCATCCACCC CATTTTCCTG ACCATTTACC TCCTCGTCCT TCCTTCCATC |
| 37301 | TGTCCTTTTA TCCATCTATT CATCCATCAC CCATCCTCCT GCCCATTCAC |
| 37351 | CTGCTTGTCC CTCCTTTCTT CTGTCCTTCT ATACATCCAT CCATCCATCC |
| 37401 | ATCCATCCAT CCACCCATCC ACTCATCCAC CACCCACCCA TCCTTCTGCC |
| 37451 | CACTCACTCG CTAGCCCCTC CTTCCTTCTG TCCTTCCATC CATCCATCCA |

TABLE 28-continued

| Genomic Repeats (SEQ ID NO: 312) |
|---|

| | |
|---|---|
| 37501 | CCCATCTTCC TGCCCATTCA CCTGCTTGTC CTTCCTTCTA TCTGTCTTTT |
| 37551 | ATCCATCTCT CCATCCATTC TCACCATCCA TCCATCCATC CTTCTCCCTA |
| 37601 | TTCACTGGTT TGTCTTTCCT TCTGTCCTTC CAACCATCCA CCCATCTCTC |
| 37651 | CATTCATTCT CCTCTTCATT CACCATGTTT CCTTATTTCT GTCTCTTCCA |
| 37701 | TCCATCCATC TATCCAGACA GACATCTCCT CCCCCCATTC TCCTCCCCAT |
| 37751 | TCACTCAATT GTCCTTCCTT CCATCTGTCC TTTTATCCAT CCATCCACCC |
| 37801 | ATCCATCCAT CCATCTATCC TTCTCCCCAT TCACCTGTTT GTCCTTCTTT |
| 37851 | CTGTCCTTCC AACCATCCAT CCATCCATCA TCCATCCATC TATCCTTTTC |
| 37901 | CCCATTCACC TGTTTTGTCC TTCCTTCTGT CCTTCCAACA TCCCTCCATC |
| 37951 | TCTCCATCCA TCCTCCTGCC TATTCATCTG CTTGTCTTTC CTTCCTTCTG |
| 38001 | TCCTTCCATC CATTCATCCA TCTGCCCATC CACCCACTCA TCCTCTTGCC |
| 38051 | CATTCACCTG CTTGTCCTTC CTTCCACCTG TCCTTTTATC CATCCATCCA |
| 38101 | TCCATCCATC TTGCTCACTC CTCCACTCAC ACAATCACTC CTTCCCTCAG |
| 38151 | TCTCATTTAT GGCCCACCTG TGAATGGTTG TCCTGGCTTG GACCACTGAT |
| 38201 | GAAGCCCAGG GGAGCTTCTC CCACTAGTGG TGGGCTTTTG TCCTCTCTGA |

| Exon R5 |
|---|

| | |
|---|---|
| 38251 | TGGACTGTTC CTTCCACAGC TCCCAAGCCA GCCACCACAT TCCTGCCTCC |
| 38301 | TCTGTCAGAA GCCACAACAG GTATTTGGGG CCATTTTTCC TCCTCGAAGA |
| 38351 | TTAGAATAGC ATTTCAATCA GACACCTGCC CTCGTGGAGT CCCAGATTTT |
| 38401 | ATGAAATAAA TAGACCATCA TAATGTCAGA TGTTTTGGGG TGAGATACCT |
| 38451 | GGCATAGTTG GGAAGGAGGA GGGCTTTCTG GAGAAAGTTT CACCTGAACT |
| 38501 | GAGTCTTTAA GGATGACTAA GAGTGATTCA GGCAAATAGG GCATGAATAG |
| 38551 | TATAACTGAA AGAGGGGAAT CTGTGAGCAA AGCCTCAGTG GCCAGAAACA |
| 38601 | GCATAGAGTA TAGGGAGAAG TGAGAGAAAT TTGGTTTGCA TGAAACATAA |
| 38651 | AGCTTAACCC AGAGTGGATG GATAAGTGAG ACTGAAAGGT CAGCAGGAGC |
| 38701 | CAGATTGGGA AGGGCCTTGA ATGCCAAGTC AAGAAATTTG AACTTAACAC |
| 38751 | TGAAGGCCAT AGGGAGCTGT GGATGGTACT AGAGCAGGGG CAGCCATAGT |
| 38801 | GAGATTGTCA TTTCAGAAAG ATTCTTCTTG TGTTCAGTAT AGAGAATGTC |
| 38851 | CTTTAGACAG GGCATCCAGT GAGTCTGCCA GGTGCTAATC AGGGTGAGAG |
| 38901 | AAAATAAGAC CTGAACTGGG ATAGGGGGAG GAGAGAGAGG ATATATGTGA |
| 38951 | TGAATATTCA GTAAAGAGAA TTGGTGTTAC TTGGAGGGGA GAAGACACAT |
| 39001 | AGCTTCTGAC TTGCGATGGC CACACTCAGT TTAATAATGA GCGCAGTCTG |
| 39051 | ATCTAGTCTC AGACCAGCCC TCAGTTGCAG ACGTCTCTCC TCCCCTCCTG |

| Exon R1 |
|---|

| | |
|---|---|
| 39101 | CAGCATGGGG TACCACCTGA AGACCCTCAC ACTCAACTTC ACCATCTCCA |
| 39151 | ATCTCCAGTA TTCACCAGAT ATGGGCAAGG GCTCAGCTAC ATTCAACTCC |
| 39201 | ACCGAGGGGG TCCTTCAGCA CCTGGTGAGA CCCTGGTCCC AGCAGCTCCT |
| 39251 | GGTGGGATAA ATCCTACCCC CAACCTCTGT TCCTCGGCTT ACCCTCTTCC |

TABLE 28-continued

Genomic Repeats
(SEQ ID NO: 312)

Exon R2

| | |
|---|---|
| 39301 | TCCTTCCTCT CAAGCTCAGA CCCTTGTTCC AGAAGAGCAG CATGGGCCCC |
| 39351 | TTCTACTTGG GTTGCCAACT GATCTCCCTC AGGTGAGACC ACTTCCTGGC |
| 39401 | CATTTGCCAG TAACAACCAC CCCTTTTGTG ACCACCCCTT CCTCAGCTTT |
| 39451 | CCCCTGCTCC TCCCTCCACT GCTCTTTACC TGCAGAGGTC TCGGGACCTC |

Exon R3

| | |
|---|---|
| 39501 | TCTAGAGTCC TCAAATGCCT CTCTCCCCAG GCCTGAGAAG GATGGGGCAG |
| 39551 | CCACTGGTGT GGACACCACC TGCACCTACC ACCCTGACCC TGTGGGCCCC |
| 39601 | GGGCTGGACA TACAGCAGCT TTACTGGGAG CTGAGTCAGC TGACCCATGG |
| 39651 | TGTCACCCAA CTGGGCTTCT ATGTCCTGGA CAGGGATAGC CTCTTCATCA |
| 39701 | ATGGTGAGTG TCAGGCTGAA CTTGGATTTA CAGTGACTTT TGGGGAGTTG |
| 39751 | GTTTCTTTGT TTTTGAGATG GAGTCTCACT CTATCACCCA GGCTGGAGTG |
| 39801 | CAATGGTGCA ATCTTGGCTC TGCAACAGTG ATTCTCCTGC CTCAGCCTCC |
| 39851 | CAAGTAGCTG GGATTTACAG GTGCATGCCA CCACGCTCAG CTAATTTTTG |
| 39901 | TATTTTTAGT AGAGATGGGG TTTCACCATG TTGCCCAGGC TGGTCTCGAA |
| 39951 | CTCCTGACCT CAGGTGATCC ACCTGCCTTG GCCTCCCAAA GTGCCAGGAT |
| 40001 | TACAGGCATG AGCCACCATG CCCGGCCCAC CATGACTATT ATTTGTCCCT |
| 40051 | GTTGTATGCC CTTTCCTCTC TAAAAAAAAT AGCCCAAGGC CTGGCTGGGG |
| 40101 | GACACCCTTC CCCAAACCAC CAAGGGGAGG GTCTTTCCCA TTATTTTGAG |
| 40151 | TAAATAGCAT GAAATTCTTT GACCAAATTA ATGTCATAAA TTGTTTGTCT |
| 40201 | CTTTCTCCTT CACTTTTGTT TCCAACTTGG TTGCGGTATA ACTATCAAAT |
| 40251 | ACAATTGTAT GTATTTAAGA TGTATAATGC AGTGATTTAA TATATGTGTA |
| 40301 | GCTTATGAAA TGATTACCAT GATCAAATTA GTTAACACTG CTTTCATGTC |
| 40351 | ACATAGTTAC CGTGTGTCTG TGTGCGTCTG TGTGAGTTAG AGAGAAAGAG |
| 40401 | AACATTTAAG GTCTACCCTC ATAGAAAATT TCAGGTTTAC AATACAGTAT |
| 40451 | TATTAACTAT AATCATCAAG CTTTATACTC GATCCCAGA ACTTATTCAT |
| 40501 | CTTGTAACTA AAAGTTTGTA TTTTGTGACC AACATCTCCC CATTTTCTCT |
| 40551 | ATCACCACCC CCATGCCCCC AGCCCTGAT AACCATCATG CTACTCTCTG |
| 40601 | CTTCTGTAAG TTTGACTTCT GATCCCACAT ATAAGTGAGA TCATGCAGTA |
| 40651 | TTTGTTTCTC TCTATCTGGT ATATTTCACT TAGCATAATG AACCCCCCCC |
| 40701 | AGGTACATCC ATAATGAATT TCAATTCAAA ACCCAAGTGG CTGAGTCGTG |
| 40751 | GCATCCTTTG GGACAGGATA GCAGGTCCCT TCTATATAAG GATCCTCTGT |
| 40801 | GTCAGTGGTT ATTACCAGGG GACAATTCTG CACTTCTGCC CCACCCCACC |
| 40851 | CCCCAACTGG GAGACTCTAG GCAATATCCG AAATCATTTT TGGGTATCAC |
| 40901 | AACTCAGGGA GGGAAGGAGG GTGCAACTGG CACCTAGTGG GTCGGTAGCC |
| 40951 | CATTTTCCAG TGCACAGGAG ACAACCACCC CAGGGAATGA TCCAGCCCCA |
| 41001 | AATGCCAATA ATTTCAAGGG TGAGAAATCC TGTTGTACAT GGTCTCAAAG |
| 41051 | TTCTTAGGTG GGCACAAGGC TGACATTTAT CACACTTTAC TGTAATTACT |
| 41101 | TGTTAAATTT ATCTGATTCC CCCTTACCCT GTGAACTCAA CAAAATTACG |

TABLE 28-continued

Genomic Repeats
(SEQ ID NO: 312)

```
41151   GTCTATTATG AGTGCCACTG TACCCTCGGT TCGCAGTACA TCAGCACATC
41201   ATAGTATGGA AAGAATCATT GAATGAGTGA GCAAATTAAA GATTTGTGTC
41251   TCTGCTGTAA CTCACATTCA TTAATTCATT CATTCAGCAA ACATATATGG
41301   GTGGCTGTTC TGCCCCAAGC CTTGTACTGG GTCTGGAGAT AGAAGACACA
41351   TTTTTCTGTC TCTGAAAAAC TCATACTCAA GTTAACAACA AATTACGGGC
41401   ACAACAAAGA CCCCACTGCT GTTATTAACA GGGTACTATG GGAGCTGAGA
41451   GGAGGAGTAA ATTAAGGAGG GCTTCCTGGA GGAGGGTGTT ATATACCCGG
41501   CCCTGTGCCG GGACACATAA TGATAAGACA GACTTGGGCC TCTGCTGTCC
41551   TGGAGCTCCC TCTCACTGGG CTCTTGAAGC GTGAGCAGGA GTTTTGCAGG
41601   AAATGAAAAG GATGCATTCC TAGAAGTGGG AACTGCATAG CACATGCAGG
41651   AAAGCTCAGC TCAGAAGAAT CTGTGTAATA TTCCATTTTT CCCTCTCTTT
41701   GGGGCAACTT TCTGTCTAAG AGCTCCTGCA ATGCCCAGCG TGTGGACCTG
41751   AAATTGATTC TGACAGTAGG CAGGGGACTG CTGGGCAACT TTGGCTCTGC
41801   ATTTTGTGAT CAACATTTCC CCACCATATG TTGCCTTTTC TTCTTCTCTG
```

Exon R4

```
41851   TGGCTCCAGG CTATGCACCC CAGAATTTAT CAATCCGGGG CGAGTACCAG
41901   ATAAATTTCC ACATTGTCAA CTGGAACCTC AGTAATCCAG ACCCCACATC
41951   CTCAGAGTAC ATCACCCTGC TGAGGGACAT CCAGGACAAG GTGGGGCATC
42001   TCTCACCCCT CCCGTCTTCT CTGTCCTGTG TGCTTCTCTC CCTCTTCTAC
42051   CTGATTTCTC TGTTAAGTGA TCACTTTAAA TGCTTCACTT CACTATGTAT
42101   TCTGGGTTCT CTCTCAGTTT CCAAAAGTAC TCTCTTGACT ACCATTCCCA
42151   TTTCACAGAT GGGCAAACTG AGGCTCAGAA AGGGGCGTGG TGTGCCTAGG
42201   GTCATACAGT GCTTTAGGAA CAGAGTTAGG ATTTGAACTC TGGTCCCCTT
42251   TGCTCCAAGT CCTGTGTTTT TTTCCACTGG CATCAGCGGC CCCTCCACCC
42301   CCAAGAGGCC TCCATCTCAC CCACTCTCCC TACCCATCTT TCTAGGTC
```

TABLE 29

Genomic Carboxy Terminal
(SEQ ID NO: 313)

Exon C1

```
  1   ACCACACTCT ACAAAGGCAG TCAACTACAT GACACATTCC GCTTCTGCCT
 51   GGTCACCAAC TTGACGTAAG TTCTGAAGGT CATAAGCAGT GACCAAGCTT
101   GTGGCTGTGT CTCTGAGCAC CCTTGAGCTA GACGTCCCCA GTGGGGTACC
151   CATTCTCCCC TACATCCCTG TCTAGCTAAT CCTACCATCT CCTCCCATAA
201   ATCCTCAAGG TAGGGAGTGA GGATTAACCT CATGGGGCCA CCAACTCCCA
251   GCATACACCT TCTTTTTTTT CTGGACACTT GGGAAAATAT AACTTTTTGA
301   TGTAGAACTC AAAATATTAG CCCAATAATA ATATTTAACA TCAACCAGCC
351   TCCTCTCATT TAATTCTCAC AACAGAATCT ATGAGTTGAG TGCAAAAATC
```

TABLE 29-continued

Genomic Carboxy Terminal
(SEQ ID NO: 313)

```
 401  ATCCCTATTG TGCAGATGGG AAAACTGAGG GTCAGAAAAG TGAACTTCCC
 451  AAGAACTGTC AAAGTTGGGA TTTGAACCCA GGTCTCTGAT GACTGGATGA
 501  AGGAATGAAG ATACCTATAC TTGGGAATGA GGAGGGTCGA CAGGACACGA
 551  GGGCTGACTT TGTATATTTC TAAACTTCAA AGATTTTCTG TATTTCAGCT
 601  GGGAATATGG TAGAAGGTTA ATTGGAACAA AAAAATGCAA AGCAATGAAT
 651  AAGACCTCAG TATTTGCTAT GCACAACAGG GTGACTGTAG TCCCACAAAT
 701  AACTTCACTG TACATTGTTA AAATATAACT AAAGGTGTAT GCTTGGATTG
 751  TTTGCAACAC AAAGGATATA TGCTTGAGGG GATGGATACC CCATTTACCC
 801  TGATGATTAT TATGCATTAC ATGCTTGTAT CAAAACATCT CATATACCCC
 851  ATAAATATAA AAACACCTAC TATGTACCCC AAAAAATTAA AAACAAATAA
1051  AGGCATGGTG GCACACACCT GTAGTCCCAG CCACTCAGGA AGCTGAGGTG
1101  GGAGGATCGC CTGAGCCTAG GAGGCTGTAC TCCAGCCTGG GTGACAGAGC
1151  GAGACTCTAT CTCAAAAAAT AAAATAAAAT AATAAAAAGT AGAAATCAAG
1201  AGGGAAAATG TGGGAGAAAT TGGGATAATT TTAACAATAC CTTCCACCAG
1251  AGTGATGATG AAGAATGCAT AAGTCACTTC TTAGTGGTCT TGATCTATAA
1301  AAAGTGTTCA ATAAATATCG ATTATTGTTA CTGTTATTGC TTCTAGACGT
1351  AATTCCTGGA AGCATTTTTT TTTTTTTTTT TTTGAGATG GAGTCATGCT
1401  CTGTTGCTCA GGCTGGAGTG CAGTGGTATG ATCTCGGCTC ACTACAACTG
1451  CCTCCTGGGT TCAAGCAATT CTCCTGCCTC AGCCCCCCAT GTAGCAGGGA
1501  CTACAGGCAT GCGCCACCAC ACCCGGTGAA GTTTTGTATT TTTATTAGAG
1551  ACAGGGTTTT GCCATGTTGG TCAGGCTGGT CTCGAACTCC TGACCTCAGG
1601  CAATTTGCCT GCCTCGGCCT CCCAAAGTGC TGAGATTACA GGCTTGGGCC
1651  ACTGCATCCA GCCGAAGGCC TCCCATTTTG ATCAGAACCC TTCTCTAGAC
1701  TGAGGGTGGG TGCCTCTAGA TCTTTTGCTC TTTAAAGACA GCAACCGATG
1751  ACCCTGCTGA TGCTGAGTAC TGGCTGAATT CCTGTGGTCT CTGTCCCTAG
```

Exon C2

```
1801  GATGGACTCC GTGTTGGTCA CTGTCAAGGC ATTGTTCTCC TCCAATTTGG
1851  ACCCCAGCCT GGTGGAGCAA GTCTTTCTAG ATAAGACCCT GAATGCCTCA
1901  TTCCATTGGC TGGGCTCCAC CTACCAGTTG GTGGACATCC ATGTGACAGG
1951  TACAAGGTGG GGTGGCTGGT TTCCTAACTG GAAGAGGTGG GGTTATGAGG
2001  AAAGATGGGG CTTCTCGGTA CCAGTGGAAT TGGTGGAGGC TCTAGAGAGG
2051  GAAAGGGAGG CTTTCTGGAG ACCCATGTAG GTGACCTCTG GCAGTAGATC
2101  ATCCAACGAG GCAGGAACAG AACACCAGCC ATTGCATCTA AGAGAATAGC
2151  TATTTTTACA TGTAAAAAGA ATTGTGTTGA ATGAATGAAT CAATAGATCA
2201  TTTATTTTGA ATCAATTTAT TGATTCATTC ATTTAATTAA TGAATAATAA
2251  ATGATTCAGT ACATAATTGA TTAATTGATG TAATTGAGAA TTGATTTAAT
2301  TGATTAATTG ATCAATTAAA ATGATCAATT AAATGAATGA ATCAGTAAAT
2351  GAATAATTCA TTCATTCAAT AAACAATGGA AGTAGGCCGG GCATGGTGGC
2401  TCACGCCTGT AATACCAGTA CTTTGGGAGG CCCAGGCAGG CAGATCACGA
```

TABLE 29-continued

Genomic Carboxy Terminal
(SEQ ID NO: 313)

```
2451  GGTCAGGAGA TTGAGACCAT CCTGGCTAAC ACGGTGAAAC CCTGTCTCTA
2501  CTAAAAATAC AAAAAAAATT AGCCAGGCAT GGTGGTGGCC ACCTGTAGTC
2551  GCAGCTACTC GGGAGGCTGA GGCAGGAGAA TGGCGTGAAC CCGGGAGGCA
2601  GAGCTTGCAG TGAGCCGAGA TCGCGCCACT GCACTCCAGC CTGGGCGACA
2651  GATGGAGACT CTGTCTCAAA ATAAATAAA TAAATAAAAA TAAAAAATAA
2701  ATAAACAATG GAAGTAAACA CGTACTGATA ACACAGTGTG ATCATTGCTA
2751  TGATAAGGGA ATTTCAGGGG CCTGTGGGAG CCCCAAGGAG GAACACACAA
2801  CCTTGTCTTG GAAAGTTTTA TGTAGGAAGG GGTGAAGAAG CTGAGATCTG
2851  ACAGAGAATG GGACCTAGCC AGGGGTAATA GATGGAGAAT TGTGCTCCAT
2901  GCATCTATAA CCTAGAAGAT AGAAAGAATA TGGCATCTGG CCGGGTGCGG
2951  TGGCTCACGC CTGTAGTCCC AGCACTTTCA GAGGCTGAGA TGGGTGGATC
3001  ACCTGAGGTC AGGAGTTCAA GACCAGCCTG ACCAATATGA TGAAACCCCA
3051  TCTCTGCTAA AAATACAAAA ATTAGCCAGG CATGGTGGTG CGTGCCTGTA
3101  ATCCCAGCCA CTTGGGAGGC TGAGAGAGGA GAACTGCTTG AACTCGGGAG
3151  GCGGAGGTTG CAGTGAGCCG AGATTGTGCC ATTGCACTCA AGCCTGGGCA
3201  AAAAGAGCAA AACTGCATTT CAAAAAAAAA AAAAGTGGCA TTTTGGGGCA
3251  AGTTTAAGAA GATTGGTGTA GCTGGAGCAT CCACTTTGAT ACTGGAGAGG
3301  TGACAGTTGA AGCCAAAGAT GTGGGCAGAG ACTTTGTTGG GCACTGGAAT
3351  GGCTTGGGGA GGAACATGAC ACACTCATGA GTTCTGCTTT AGAAAGAAAA
3401  TGAAATGAAT TCTGCTCATC CTCTGGGTGC TGTGTGCAGA ATGGAGGGTG
3451  GGGGGAGAGA AGAGCAAAGG CAAGAAGACC CTTTAGGAAC AATGATCATT
3501  AGTTAGAAGA CTCTGGGTTT CTCAGCACCT GCAATTGCTG ACTACACCCC
3551  CAGAGAAACC CAGTCTCTTT TCCCCCATGT TGTAGAGAAT TCTTACAATG
3601  CTTGGTAGAA AGAGAATTGA ACAGGTAGAT GGGTGGATGG ATACAAGCTG
3651  GACAGATGGA TGGAGGAAGA TCCTCCATCC AATATAGAGC TGTTACCTAA
3701  AACCCTCCAT CCCACCTTTA AAATCCTAGC TCAGCCAGGC GCGGTGGCTC
3751  ACACCTGTAA TCCCAGCACT TTGGGAGGCC AAGGCGGGTG GATCACTTGA
3801  GGTCGGGGGT TCGAGACCAG TCTGACCAAC ATGGTGAAAC CCCCTTCTCC
3851  ACTAAAAATA CAAAAAAAAA AAAAGTTAG CCAGGCAGGG TGGCGCATGC
3901  CTGTAATCCC GCTACTCGGG AGGCTGAGGC AGGAGAATGG CTTGCACCCA
3951  GGAGGTGGAG GTTGTGGTGA GCCAAGATCA CGCCATTACA CTCCAGCCTG
4001  GGCAAAGAGA GTGAAACTGT CTCAAAAAAC AAAACAAATG ACCCCCCTGC
4051  CAAAAAAAAA AAAAAAAAAA AAGAAAAGAA AGAAAGAAAA GCCTAGCTCA
4101  GCTCACACTG TCAGGAATAA GTAAGCTAGC TGGAATCATC TCTTTCTTAA
```

Exon C3

```
4151  AACCCTGCCT TGATAGTGGA TTTTTACATA CTTTTTTTTT AATTCTAGAA
4201  ATGGAGTCAT CAGTTTATCA ACCAACAAGC AGCTCCAGCA CCCAGCACTT
4251  CTACCTGAAT TCACCATCA CCAACCTACC ATATTCCCAG GACAAAGCCC
```

TABLE 29-continued

| Genomic Carboxy Terminal (SEQ ID NO: 313) | |
|---|---|
| 4301 | AGCCAGGCAC CACCAATTAC CAGAGGAACA AAAGGAATAT TGAGGATGCG |
| 4351 | GTGAGAAGGG GGTGGTATGT CCACTCTGTT GCCATGCAGA AACTGACTTA |
| 4401 | TGCATACTGG GTAGCCACAG GGTGACTTTT TATAACAATC CACAAAGACA |
| 4451 | GGTTCTTATT CCCATTTAAT ACACAAGCAC AGAGAGGTTC AGTAGCTGAC |
| 4501 | CCAAGGTCAC ACAGCTAAGT CATACCCTAG AAGAGCATGT CCTTTGATAT |
| 4551 | ACATACCTGG GCAAGTGGTT GTCATGACAA GAAGCAAAAT AGACGGAGAA |
| 4601 | GTGTGCTCAG TGGCTGAAAA TTCTCTGATG CTACTGGGGC CAGGATTCTG |
| Exon C4 | |
| 4651 | ACCTAAGAAA CATCGCCCTG TCTTTCAGCT CAACCAACTC TTCCGAAACA |
| 4701 | GCAGCATCAA GAGTTATTTT TCTGACTGTC AAGTTTCAAC ATTCAGGTAA |
| 4751 | GTTCTAACTC AGGACCTAAT GACTCTAGGA ACTTCTGCTG TCCTTTAAAT |
| 4801 | AGAAGTGTCC CCAAGCCATA GCTTTGATGG AAGAGAGCCC TAGAAATAGA |
| 4851 | GAGCTGTTAA CTAAAAACTA GCTTTTTCCT AAAGCTGGAG CCCAACTGGC |
| 4901 | TTCAACACTC AAGAGAGCTG GTGTAAATCT CAGCAGACAT AAAGGTACCT |
| 4951 | GGTGCTGAGG CCATGGAGTC TAGAGTGTAG AATCTACTAC ATTAAGACAT |
| 5001 | CAGCTACTGA ATCAGGACC CATGGAAGAC GGGGGAAGGA GGGGACTAAA |
| 5051 | ACCAGATTAC TTAGAATCTA GCAGCCTAAC TGTGCTTTTC AATGAGAGGT |
| 5101 | ATCATTTCCA ATGGTGGGGG GTACCAATGA TTTTTTTTTT TTGACAACTG |
| 5151 | CCTTGAGAAC AGGCTTTCCT CACTAAACAA ATTCTGAATC AGAACAAATA |
| 5201 | AAGATAAGCC CTGAGAATAG GGCTTTTTCA AGGAGCTGCC AAACAGATCA |
| 5251 | AATAGTGACT ATGTTCTGCA GATTGATGTC TGGAGAACTC TACAGCTATT |
| 5301 | TTGACTGCTA GGCAGCTGGT TTTCACAGAT ATCATGATTC TGAGGCTGCC |
| 5351 | AGTTTTCAAA GTTACCGAGG ATCTTGCTGG ATGCAGTGGC TTGCGACTGT |
| 5401 | AATCCCAGCC CTTTGGGAGG CCAAGGTGGG TAGATCGCTT GAGCTCAGGA |
| 5451 | GTTTGAGACC AGCCTGGGCA ATATGGTGAA AACCCATCTC TACAAAAAAT |
| 5501 | ACAAAAATCA GCTGAGCATA GTGGCATGTG CTGTAGTCCC AGTTACTTAG |
| 5551 | GAGGCTGAGG TGGGAGGATG GCTTGAGCCC AGGAGGCAGA GGTTGCAGTG |
| 5601 | AGCTGACATT GTGCCATGCA CTCTAGCCTG GGCAACAGAG CCAAAGCCTG |
| 5651 | TCTCAAAAAA AAAAAAACAA ATAATAATAA TAATAAAATA CTGAGGATCT |
| 5701 | TGAAAGAGCA CTGTGGAAAT AATGCAAGTT AAAATGCCAC AAAGCTTGCT |
| 5751 | CTTTTTACTG AGATTTAACA CTTTCCTTAA CTAAACACCC CTCGAATTTT |
| 5801 | TGCAAGCCTT TGGTTCACTT CTAGACTTCT GGAAAAATTG ATTTGGACTA |
| 5851 | TTTTGGCCAA TGTTCTCATT GATTTTATGG GTATTCAGAA GTTGTTACCC |
| 5901 | CAACATTCCA GAAATGTTCT CCCTGTGGCT ATTACTTTAT TTATTTATTT |
| 5951 | ATTTATTTAT TTATTTATTT ATTTGAGACG GAGTCTCCCT CTGTTGCCCA |
| 6001 | GGCTGGAGTG CAGTGGCGCA ATCTCAGCTC ACTGCAACCT CCGCTTCCCA |
| 6051 | GGTTCAAGCG ATTCTCCTGC CTCAGCCTCC CAAGTAGCTG GGATTATGGA |
| 6101 | TGTGCACCAC CACACCGGCT AATTTTTGTG TTTTTAGTAG AGATGGGGTT |
| 6151 | TCACTGTGTT GGCCAGGCTG GTCTCGAACT CCTGATCTCA AGTGATCCAC |

TABLE 29-continued

Genomic Carboxy Terminal
(SEQ ID NO: 313)

```
6201  CCGCCTTGGC CTCCCAAAGT GCTGGGATAA CAGGCATGAG CCACTGTGCC
6251  TGACCTCCCT GTGGCTATTT TTAAATGAAT TAAGTGGAAT AAAATTAGAA
6301  ATTCAGTTCT TCTCCCACGC TAGCTGCATT TTAAGCATTT AATAACAACA
6351  TGAAGCTACT AATGGCTGCA TTGTGTAGTG CAGATGTAGA ATTTTTTTTT
6401  TGTTTTTTGT TTTGTTTTTG AGATGGAGTC TCGCTCTGTC ACCAGGCTAG
6451  AGTGCAGTGG CGTGATCTCG TCTCACTGCA ATCTCTACTC CCCGATTCAA
6501  GTGATTCTCC TGCCTCAGCC TCCCAAGTAG CTGGGATTAC AGGCACGTGC
6551  CACCACACCC AGCTAATATT TGTATGGATG GTCTCAATCT CCTGACCTCG
6601  TGATTTGTAT GGATGGTCTC GATCTGACCT CATGATCCGC CTGCCTGGGC
6651  CTCCCAAAGT GCTGGGATTA CAGGCGTGAG CCACTGTGCC CGGCCGACAT
6701  AGAATGTTTA CATCATTGCA GAAAGTTTCT GCAGGAAGAG CCTAGAAGGA
6751  GAAAGCCTAG AATCATGATA AAATTGCAGA TATCTTTGCT TATCCCTGTC
```

Exon C5

```
6801  CCCTTCCAGG TCTGTCCCCA ACAGGCACCA CACCGGGGTG GACTCCCTGT
6851  GTAACTTCTC GCCACTGGCT CGGAGAGTAG ACAGAGTTGC CATCTATGAG
6901  GAATTTCTGC GGATGACCCG GAATGGTACC CAGCTGCAGA ACTTCACCCT
6951  GGACAGGAGC AGTGTCCTTG TGGATGGTAA AGCTCCCTGG GTCATTGGGA
7001  CTGAGGTGGA AGCTCCCACT TCCTCACCTG GTCCTTCCC TGGGAATCTG
7051  AAGGCTTGGG GTTGATTCGT CATCGAGCTT TCTCAGACTG GGAGAAAGTG
7101  GCTTAGTTCT CCTAAGCTTT ACCCATCATT GAAGGAAAGA AAAGGACGCC
7151  CGAGGGATAT GGGAGGCATT TGCCCTCTTC TGGCCAGCTC TGTGACCTCA
7201  GGCTAGTCAC ATCTCCTTTC TGGACTTCTT ATCTCTCTGT ACTTAGCAAG
7251  CCACTTGGTT TTTGGTTCCC ATCTTGCCTG CCCTAGATGG TATTGCTCCT
7301  CCACCCCCAG GCAGCTGCAG TGTTAAACAA TTACCCTGAT TAGTTATTGT
7351  TGTTGTGTTG TTTGTTTGTT TTTGAGACAG GGTCTCACTC TGTCACCTAG
7401  GCTGGAGTGC AGTGACATGA TCTCAGCTCA CTGCAACCTC AACCCCTGGA
7451  CTCAAGCAAT CCACCCACTT CAGCCTCCCA AGTAACTGGG ACTACAGCCA
7501  TGCGCCACCA CACCCGGATA ATTTTTGTAT TTTTTCTAGA GATGGGGTTT
7551  TGCAACATTG CCCAGGCTGG TCTTGAACTC CTGAGCTCAA GCATGCCACC
7601  TGCTTCAGCC TCCCAAAGTG CTGGGATTAC AGGCAGGCAG GCACCACTGC
7651  AGCTGGTTCT GGTTTTTGT GTTTGTTTT TTCTTTTAGA GGCAGGGTCT
7701  CGCTCTGTTA ACCAGAATGG AGTACAGTGG TGCAATCATA GCTCACTGCA
7751  GTCTTGAACT CCTGGGCTCA AGCGATCCTC CCACCTCAGC CTCCTGAGTA
7801  CCTGGAACTA CAGGCACGTG TCACCACGCC TTGCTAATTT CTAAATTTTT
7851  TGTAGAGACA GGGTCTCACT ATGTTGCCCA GACTGGTCTC TAATTCCTGG
7901  CCACAAGTGA TCCTCCTGCC TCAGCAGGTC AATGAGGGCT TCCAGTTTCA
7951  AGTTGTATGT GATTCATCCT CAACAAATGT GGTAGGATGG ACCTATTTTC
8001  CAACTCCAGA GATGGCTTCA AGGTGGCTCA ACTTTGCATA TCCAATTTTA
```

TABLE 29-continued

Genomic Carboxy Terminal
(SEQ ID NO: 313)

```
8051   CCCATTCAAA GAATAGTTAT ATACATTGTA CCATGTATCA GGAATATAAC

8101   AGAGAGTAAC TGTTTGCTCT TCACCACTA TATTCCAAGA ACCCCATATT

8151   CTGCCTGGCA CATAATAAAC ACTCAAGTCA TATTTGCAGA AGGAATAACT

8201   AGATTTCATA CAAGGTTCTT TTCAAGTCAA ATGCGAATAA CGTTTTAGAC

8251   GGGACCTTCC AATGCCTGTG TGCACTGTCC TTGATTCCGA ATTATTGTTG

8301   TGCAAGAGAG CACTGTTGAT CCTTCAGAAT CAACAAGCCT TTCACATGCC

8351   TGTCACAGGT TTTTCTTTTT CTTGTTTTAC CAATTTTGTT TGTTGTTTGT

8401   TTGTTGTTAT TGTTTTGTTT TGTTTTTGTT TTTTATTTGT TTTTATTTTT

8451   TCTTTTTTTT TGAGACAGAG TCTCGCTCTG TCACCCAGGC TGGAGTGCAG

8501   TGGCACGATC TCCGCCCACT GCAAGCTCCG CCTCCTGGGT TCATGCCATT

8551   TTCCTGCCTC AGCCTCCTGA GTAGCTGGGA CTACAGGCGC CTGCCACCAT

8601   GTCTGGCTAA TTTTTTTTGT ATTTTTAGTA GAAACAGGGT TTCACCATGT

8651   TGACCAGGAT GGTCTCGATC TCCTGACCTC GTGATCTGCC CACCTGGGCC

8701   TCCCAAAGTG CTGGGATTAC AGGCGTGAGC CACCACACCC AGCCCCAATT

8751   TTTTTTTTAA TTAAAATTGT TGTCAGCTCA CAAGCTTTCT AAAAACAGGC

8801   CATGGACCCA GCATCGCTGT AGTTTGCCAA ACCCTTGCCT TGAATCAGTA

8851   CCATCCAATA GAACTTTCTG CAGTGATAGA AAATGTTTCT ATCTGTGCTA

8901   TTCAGCACAA AGCCATGTGT GATTACTAAG CTTGAAGTGT GGTTAATGTA

8951   ACTGAGATAC CGAAGTTTTA ATTTTATTTA ATTTTAATTT AAAAAGCCAC

9001   TTGTGGCTGC TCCATATTGC ACACTACTTT TTAAAATTAT TATTTGTATA

9051   TATTTAAGGG GCACAAGTAC AATTTTGTTG CATGGATTTA TAGCCCAGTG

9101   GGGAAGTCTG GCTTTTAGG GTATCTATTA CCTGAATAAT GTACATTGTA

9151   CCCATTGAGT AATTTCTCAT CATCCACTCT CCTCCACTCC CCAACCCTTC

9201   CAAGTTTCCA CTGTCTATTA TTCCACTCTC TATGTCCATG CCTATGCATT

9251   ATTTAGCATT GACATGTCTA TGCATTATTT AGTCAAATAC ATGTGCTATT

9301   TGACTTCCTG TATCTGAGTT GTTTGACTTA AGATAATGAC CTTCACTTGC

9351   ATCCATGTTG CTGCAAAAGA CATGATTTCA TTCTTTTTTA TGCCTGGGTG

9401   GTATTGCATT GTGTGTGTGT GTGTGTGTGT GTGTGTAGAG AGAGAGAGAG

9451   ATCACATTTT CTTTATACAG TCCTCCATTG ATGGGCACTT AGGTTGATTC

9501   CATATCTTTG CTATTGTGAA TAGTTTTGTG ATAAACACAC AGGTTCAGGT

9551   GTCTTTTTGA CAAAATTATT TATTTTCCTT TGTGTAGATA CCCAGTCGTG

9601   GGATTCCTGG ATCAAATGGT AGTTTCATTT TTAGTTATTT GAGAAATCTC

9651   CACGTTTTTC ATAGAGATTA TACTAAATTA CATTCCCACC AACAGTGTGT

9701   AACGGTTCAC TTTTCTTGCA TCCTTTTTAA CATCTGTTAT TTTTGTCTTT

9751   TTAGTAACAG CCATTCTGAC TGGCGTAAGG TGGTATCTCA TCATGGTTTT

9801   AATCTGTATT TCTCTGATTA TTAGTAATGT CGAGCATTTT TTCATATGCT

9851   TGTTAGCCAT TGGTATGTCT TCTACATCTT TAAGAAGCTG GCTATGGGCT

9901   GGGCGCAGTG GCTCACACCT GTAATCCCAG CACTTTGGGA GGCCGAGGCA

9951   GGCGGATCAC GAGGTCAGGA GTTAAAAACC AGCCTGGCCA ACATGGTAAA
```

TABLE 29-continued

Genomic Carboxy Terminal
(SEQ ID NO: 313)

10001 ACCCTGCCTC TACTAAAAAT ACAAAAAATT ACCCAGGCAT GGTGGTGCGC

10051 CTGTAATCCC AGCTACTCAG GAAGCTGAGG CAGGAGAATC ACTTGAACCC

10101 AGGAGGCGGA GGTTGCAGTG AGACGAGATC ACATCATTGC ACTCCAGCCT

10151 GGGTGACAGA GTGAGACTCT ATCTTGAGAA AAAAAAAAG TTGGCTATAA

10201 CAGGGTTGTA GAAGTAGAGG AACCAGTAAC CCTTCTCGCC ATGCCTGATG

10251 ATGGCTTTAC ATCCCTGTCT TCATGGAGTT TATGCTGTCG TGAGGAATAA

10301 CAAGAACAGG CAGTTGTCAA TTATAAATTA TTTGATGTGA ACCTATTCAT

10351 ACATGGGTGT GGTCATCAGG GAAGGCTTCC TGGAGGAAAT GACATTGAAG

10401 GTGAATTCTA AAAGATGACG ATAAACCACC AAGTGAAGGA GAGCTTAAAT

10451 GTGTTTTTAG GCAGAAGAAA AACCTTTTGG GTGAAAATTT TAAAACTTAG

10501 AGAGGTCCCA TCAGTTTCCA ACTGCGATGA TCCATTCTCT CCACCACTGC

10551 CCTTGGGCCC AGCCCAATTT AGGTCCACCA TGCCCAGAGG CATGAATTTA

10601 ACTTATGACA CTCTTGTGGT GGAATAATGG CTTTGGGCTT ATGTAGCCAT

10651 GTGTCATTTT TTTAGAGATA CAAATTGAAA TATTTGGGGT GAGATGTCAT

10701 GGTGTCTACT GGCCTCTAAA ACTTCAGTGA AAACATTTAC TTTCACTGAA

10751 ATGTCAATAA ATCATAAATT GGATGTATAT GTTTTAGTTG GAGGAAATAT

10801 AAACCACTAA ATCTAGGTGA TGCATATTTA TTATACTCTT CTCTCTGCTT

10851 TTTTGTACGC TTGTAAAATT GTATTTAAAA GAATAAGACA CACTTGGCCG

10901 GGCGCGGTGG CTCACGCCTG TAATCCCAGC ACTTTGGGAG ACCGAGGTGG

10951 GTGGATCATG AGGTCAGGAG TTCAAGACCA GCCTGGCCAA CATGGTAAAA

11001 CTCCATCACT ACATACAAAA ATTAGCCAGG CATTTTGGCG GGCACCTGTA

11051 ATCTCAGCTA CTTGGGAGGC TGAAGCAGGA GAATTGCTTG AACCCGGGAA

11101 GCAGAGGTTG CAGTGAGCCA AGATCACGCC ACTGCACTCT AGCCTGGGCA

11151 ACAGAGCAAG ACTCCATCTC CAGAAAAAAA AAAAAAAAA GACACACTCA

Exon C6

11201 CATGCACCCT CCATTTCTTT CATTTCTAGG GTATTCTCCC AACAGAAATG

11251 AGCCCTTAAC TGGGAATTCT GGTAAGTCTC AAAGAAGCCC CAGCCCAGGG

11301 TAGGGAGGGG GTAGCCTGAT GGTGCTTTGC CTTGTCCAAG AGCACCAGGC

11351 ACACAGAGTC TTGGATGAGG ATCAAAATTG CCAACCCATG GCAAAGACTA

11401 TTGAGGCATA GTAAAGGGAT AGCAGGGATC CTGGCTTTCT GGGGGCCCAG

11451 TTTTTGGGGG CATCAGAGGC ATGAGGTGTT GAGCCACTAA GCTCTCTTCC

11501 CCAGGGGCTG TGCCCATCCT CAGGCCACAT AGGGTCCAAG AAGGAGCCCT

Exon C7

11551 GGGACGTGGC AGGAGGTGGC TCACCCCAGC CCTTGTCTCC CCAGACCTTC

11601 CCTTCTGGGC TGTCATCCTC ATCGGCTTGG CAGGACTCCT GGGAGTCATC

11651 ACATGCCTGA TCTGCGGTGT CCTGGTGAGC AAGGAAGGGT TGCTTGTCTT

11701 CTTAACAATT GGGTTGTAAG AGTTCTTAAT ATATTATAAA ACCATACTAT

11751 ACTATACACA AGTCCTTTGC TGGATATATG TTTTGCAAAT ATTTTCTCCC

TABLE 29-continued

Genomic Carboxy Terminal
(SEQ ID NO: 313)

```
11801  AGTTCACGGA GTGGCTTTCC TATTTTCTTT TTATAATTTT ATTTTTAATT

11851  AATTGACAAA TAATGAATGC ATATATTTAG GGGATACAAT GTGATGCTTT

11901  GGTATATGTA CAATTATGGA ATGACTCAAT CAAGCTAATT AATATGTCCC

11951  TCACCTCTCA TACTTATTAT TTCTTTGTGG TGTGAACATT GGCAACCTAT

12001  ACTCTTAGCA ATTTTGAAAT CTACATTATT ATTAACTATA GTTACTATGT

12051  TATGCAGATC TCAAAAACTT CACAACCTAT ATGCTGATTA CAAGATATTG

12101  AGAGAAAAAG TGATTGCAAA GAGTGTAAAT AAAATAATGT AAGAGGGAAA

12151  AATGTAACAA AATTAGTCGT TAGGGAAATG TACACGGAAG TCACAATGAG

12201  AGGCCACTTT TCACAAGAAT GGATAAAATT GAAAGATTG ACTATAACAA

12251  GTGTTGGTGA AAATGTGACA GAACTGGAAC TCTCATAAAG TGAAAGTGGA

12301  AAATAGCTTG GCCATTTCTT TGAAAATTAC ACACACCTAC CGTAAGACCT

12351  ACCATCCCAC TACTAGTAAT TTATCTAAGA GAAATAAAAA CATATGTCTA

12401  TATGAAGACT TGTACACAAG TAAATGTTCA TAACAGCTTT GTTTGTAATA

12451  GCCAAACTCT GAAAACAAGC CCCTAATGTC CATTAACAAA TATATCCTGA

12501  CAATGGAATA TTATTCAGCA ACAAAAAGGA ATTATTAATA CATTAATAAA

12551  TTATACAGCA ACATGTATAA ATTGCAAAAT AGTTATGCCT AGTGAAAGAA

12601  TCCAGATGAA GAAAAGAGTA CATGCCATAT GATTCCCTTA ATAGACAAAT

12651  TCTAGAAAAT ACAAACTAAT CTGTAAGGAC AGGAATCAGA TCAGCGGTTG

12701  CCTGGGAATG AAAATGTGTT TGCAGTGGCA GGGAAAAAGG AATTGTAAAA

12751  GAGCAGGAAG AAAGTTTTTT TGTTGTTTTT TTTTGTTTT TTCTTGAGAC

12801  AGAGTCTTAG TCTATCGCCC AAGCTGGAGT GCAATGGCAC GATCTCAGCT

12851  CATTGCAACC TCTGCCTCTC GGGTTCAAGC GTTTTCCTG CCCCAGCCTC

12901  CCAAGTAGCT GGGATTACAC ATGCGCACCA CCACACTCAG CTAATTTTTG

12951  TATTTTTAGT AGAGACGGGG TTTTACCATG TTGGCCAGGC TGGTCTCGAA

13001  CTCCTGACCT CAGGTGATCC ACCCGCCTTG GCCTCCCAAA GTGCTGGGAT

13051  TACAGGAGTG AGCCACCATG CCTGGCCAGG ACGAAAGTTT TGGGGATGAT

13101  GGATGGATGT TCCTTATGTT GATTGTGGTG ACGATTCAAT AAGTTATGAT

13151  CAGAACTTAT CAAAACATTC ACTTTAAATG TGTGCAGTTT ATTTTATGTC

13201  AGTTATGCCT CAGTTAAGCT GGACAGATGT AGAGGAGGAA GGGAGGGAGA

13251  GAGGGGGCTG AGATCAGGAC CAAAAGCCAG AGAGAAAGAG ACTGAGAATG

13301  AGATGAGAGA GAAATGGTAT TTAGACAGAA GACAGGCGAT AGATGATTGA

13351  TAGTTGACAG ATGATTGGTG GATANNNNNN NNNNNNNNNN NNNNNNNNNN

13401  NNNNNNNNNN NNNNNNNNNN NNNNNNNNNN NNNNNNNNNN NNNNNNNNNN

13451  NNNNNNNNNN NNNNNNNNNN NNNNNNNNNN NNNNNNNNNN NNNNNNNNNN

13501  AGGAGGTTTA AACAAAACGC AATTATGTTG AAATGACAAT GATTGTGGAT

13551  ATAAAGGTAG ATAGAAATAG ATATTTGTGA AGATAATGGT TAGATAAAAA

13601  TGATAGGTAA CAGATATTGA TAGATCTTGA TAAGTAGATG ATAAATACAT

13651  GATTGATGGA TGACAGGTGA TTGATAGATG ATTTGATGGA TTATAAATAG

13701  GAGATGATTG AGAGGTGAGA GATAATTGAT GGTTATTTGA TTGGTAGATA
```

TABLE 29-continued

Genomic Carboxy Terminal
(SEQ ID NO: 313)

```
13751  ATTGATTGAC AGGTTGATAA ATATTGATAG CTAGATGATA GATAAATAGA

13801  TCATTGGTAG ATATGTGATA TATTGATAAA GAAATTCAGA GGCAAAAGGA

13851  GAGAGAAATG AAGGGGATAT CGGAGGGGGA AAAATTTTTT TAAACCGAGA

13901  GTGAAACAAG GAGACAGAAG AAAAGAAAGT GGTGAAAAGA GGAAAAGAAC

13951  TGAGGGAGAA ATTAAATGAA ACAATGAAGG GAGACAGAGG AAGCATAAGG
```

Exon C8

```
14001  CCTCTGGCTT TGGCCATATT CTCACCCCTG TGGTCTCCTC TCCCTGGACG

14051  GCTGACCAGT CCATTCTCAC GCCTCCTCCT CACCCTCATA GGTGACCACC

14101  CGCCGGCGGA AGAAGGAAGG AGAATACAAC GTCCAGCAAC AGTGCCCAGG

14151  CTACTACCAG TCACACCTAG ACCTGGAGGA TCTGCAATGA CTGGAACTTG

14201  CCGGTGCCTG GGGTGCCTTT CCCCCAGCCA GGGTCCAAAG AAGCTTGGCT

14251  GGGGCAGAAA TAAACCATAT TGGTCGG
```

TABLE 30

Human cDNA of CA125
(SEQ ID NO: 314)

```
   1  AAGCGTTGCA CAATTCCCCC AACCTCCATA CATACGGCAG CTCTTCTAGA

51  CACAGGTTTT CCCAGGTCAA ATGCGGGGAC CCCAGCCATA TCTCCCACCC

101  TGAGAAATTT TGGAGTTTCA GGGAGCTCAG AAGCTCTGCA GAGGCCACCC

151  TCTCTGAGGG GATTCTTCTT AGACCTCCAT CCAGAGGCAA ATGTTGACCT

201  GTCCATGCTG AAACCCTCAG GCCTTCCTGG GTCATCTTCT CCCACCCGCT

251  CCTTGATGAC AGGGAGCAGG AGCACTAAAG CCACACCAGA AATGGATTCA

301  GGACTGACAG GAGCCACCTT GTCACCTAAG ACATCTACAG GTGCAATCGT

351  GGTGACAGAA CATACTCTGC CCTTTACTTC CCCAGATAAG ACCTTGGCCA

401  GTCCTACATC TTCGGTTGTG GGAAGAACCA CCCAGTCTTT GGGGGTGATG

451  TCCTCTGCTC TCCCTGAGTC AACCTCTAGA GGAATGACAC ACTCCGAGCA

501  AAGAACCAGC CCATCGCTGA GTCCCCAGGT CAATGGAACT CCCTCTAGGA

551  ACTACCCTGC TACAAGCATG GTTTCAGGAT TGAGTTCCCC AAGGACCAGG

601  ACCAGTTCCA CAGAAGGAAA TTTTACCAAA GAAGCATCTA CATACACACT

651  CACTGTAGAG ACCACAAGTG GCCCAGTCAC TGAGAAGTAC ACAGTCCCCA

701  CTGAGACCTC AACAACTGAA GGTGACAGCA CAGAGACCCC CTGGGACACA

751  AGATATATTC CTGTAAAAAT CACATCTCCA ATGAAACAT TTGCAGATTC

801  AACTGCATCC AAGGAAAATG CCCCAGTGTC TATGACTCCA GCTGAGACCA

851  CAGTTACTGA CTCACATACT CCAGGAAGGA CAAACCCATC ATTTGGGACA

901  CTTTATTCTT CCTTCCTTGA CCTATCACCT AAAGGGACCC CAAATTCCAG

951  AGGTGAAACA AGCCTGGAAC TGATTCTATC AACCACTGGA TATCCCTTCT

1001  CCTCTCCTGA ACCTGGCTCT GCAGGACACA GCAGAATAAG TACCAGTGCG

1051  CCTTTGTCAT CATCTGCTTC AGTTCTCGAT AATAAAATAT CAGAGACCAG
```

TABLE 30-continued

Human cDNA of CA125
(SEQ ID NO: 314)

| | |
|---|---|
| 1101 | CATATTCTCA GGCCAGAGTC TCACCTCCCC TCTGTCTCCT GGGGTGCCCG |
| 1151 | AGGCCAGAGC CAGCACAATG CCCAACTCAG CTATCCCTTT TTCCATGACA |
| 1201 | CTAAGCAATG CAGAAACAAG TGCCGAAAGG GTCAGAAGCA CAATTTCCTC |
| 1251 | TCTGGGGACT CCATCAATAT CCACAAAGCA GACAGCAGAG ACTATCCTTA |
| 1301 | CCTTCCATGC CTTCGCTGAG ACCATGGATA TACCCAGCAC CCACATAGCC |
| 1351 | AAGACTTTGG CTTCAGAATG GTTGGGAAGT CCAGGTACCC TTGGTGGCAC |
| 1401 | CAGCACTTCA GCGCTGACAA CCACATCTCC ATCTACCACT TTAGTCTCAG |
| 1451 | AGGAGACCAA CACCCATCAC TCCACGAGTG GAAAGGAAAC AGAAGGAACT |
| 1501 | TTGAATACAT CTATGACTCC ACTTGAGACC TCTGCTCCTG GAGAAGAGTC |
| 1551 | CGAAATGACT GCCACCTTGG TCCCCACTCT AGGTTTTACA ACTCTTGACA |
| 1601 | GCAAGATCAG AAGTCCATCT CAGGTCTCTT CATCCCACCC AACAAGAGAG |
| 1651 | CTCAGAACCA CAGGCAGCAC CTCTGGGAGG CAGAGTTCCA GCACAGCTGC |
| 1701 | CCACGGGAGC TCTGACATCC TGAGGGCAAC CACTTCCAGC ACCTCAAAAG |
| 1751 | CATCATCATG GACCAGTGAA AGCACAGCTC AGCAATTTAG TGAACCCCAG |
| 1801 | CACACACAGT GGGTGGAGAC AAGTCCTAGC ATGAAAACAG AGAGACCCCC |
| 1851 | AGCATCAACC AGTGTGGCAG CCCCTATCAC CACTTCTGTT CCCTCAGTGG |
| 1901 | TCTCTGGCTT CACCACCCTG AAGACCAGCT CCACAAAAGG GATTTGGCTT |
| 1951 | GAAGAAACAT CTGCAGACAC ACTCATCGGA GAATCCACAG CTGGCCCAAC |
| 2001 | CACCCATCAG TTTGCTGTTC CCACTGGGAT TTCAATGACA GGAGGCAGCA |
| 2051 | GCACCAGGGG AAGCCAGGGC ACAACCCACC TACTCACCAG AGCCACAGCA |
| 2101 | TCATCTGAGA CATCCGCAGA TTTGACTCTG GCCACGAACG GTGTCCCAGT |
| 2151 | CTCCGTGTCT CCAGCAGTGA GCAAGACGGC TGCTGGCTCA AGTCCTCCAG |
| 2201 | GAGGGACAAA GCCATCATAT ACAATGGTTT CTTCTGTCAT CCCTGAGACA |
| 2251 | TCATCTCTAC AGTCCTCAGC TTTCAGGGAA GGAACCAGCC TGGGACTGAC |
| 2301 | TCCATTAAAC ACTAGACATC CCTTCTCTTC CCCTGAACCA GACTCTGCAG |
| 2351 | GACACACCAA GATAAGCACC AGCATTCCTC TGTTGTCATC TGCTTCAGTT |
| 2401 | CTTGAGGATA AAGTGTCAGC GACCAGCACA TTCTCACACC ACAAAGCCAC |
| 2451 | CTCATCTATT ACCACAGGGA CTCCTGAAAT CTCAACAAAG ACAAAGCCCA |
| 2501 | GCTCAGCCGT TCTTTCCTCC ATGACCCTAA GCAATGCAGC AACAAGTCCT |
| 2551 | GAAAGAGTCA GAAATGCAAC TTCCCCTCTG ACTCATCCAT CTCCATCAGG |
| 2601 | GGAAGAGACA GCAGGGAGTG TCCTCACTCT CAGCACCTCT GCTGAGACTA |
| 2651 | CAGACTCACC TAACATCCAC CCAACTGGGA CACTGACTTC AGAATCGTCA |
| 2701 | GAGAGTCCTA GCACTCTCAG CCTCCCAAGT GTCTCTGGAG TCAAAACCAC |
| 2751 | ATTTTCTTCA TCTACTCCTT CCACTCATCT ATTTACTAGT GGAGAAGAAA |
| 2801 | CAGAGGAAAC TTCGAATCCA TCTGTGTCTC AACCTGAGAC TTCTGTTTCC |
| 2851 | AGAGTAAGGA CCACCTTGGC CAGCACCTCT GTCCCTACCC CAGTATTCCC |
| 2901 | CACCATGGAC ACCTGGCCTA CACGTTCAGC TCAGTTCTCT TCATCCCACC |
| 2951 | TAGTGAGTGA GCTCAGAGCT ACGAGCAGTA CCTCAGTTAC AAACTCAACT |
| 3001 | GGTTCAGCTC TTCCTAAAAT ATCTCACCTC ACTGGGACGG CAACAATGTC |

TABLE 30-continued

Human cDNA of CA125
(SEQ ID NO: 314)

```
3051  ACAGACCAAT AGAGACACGT TTAATGACTC TGCTGCACCC CAAAGCACAA
3101  CTTGGCCAGA GACTAGTCCC AGATTCAAGA CAGGGTTACC TTCAGCAACA
3151  ACCACTGTTT CAACCTCTGC CACTTCTCTC TCTGCTACTG TAATGGTCTC
3201  TAAATTCACT TCTCCAGCAA CTAGTTCCAT GGAAGCAACT TCTATCAGGG
3251  AACCATCAAC AACCATCCTC ACAACAGAGA CCACGAATGG CCCAGGCTCT
3301  ATGGCTGTGG CTTCTACCAA CATCCCAATT GGAAAGGGCT ACATTACTGA
3351  AGGAAGATTG GACACAAGCC ATCTGCCCAT GGAACCACA GCTTCCTCTG
3401  AGACATCTAT GGATTTTACC ATGGCCAAAG AAAGTGTCTC AATGTCAGTA
3451  TCTCCATCTC AGTCCATGGA TGCTGCTGGC TCAAGCACTC CAGGAAGGAC
3501  AAGCCAATTC GTTGACACAT TTTCTGATGA TGTCTATCAT TTAACATCCA
3551  GAGAAATTAC AATACCTAGA GATGGAACAA GCTCAGCTCT GACTCCACAA
3601  ATGACTGCAA CTCACCCTCC ATCTCCTGAT CCTGGCTCTG CTAGAAGCAC
3651  CTGGCTTGGC ATCTTGTCCT CATCTCCTTC TTCTCCTACT CCCAAAGTCA
3701  CAATGAGCTC CACATTTTCA ACTCAGAGAG TCACCACAAG CATGATAATG
3751  GACACAGTTG AAACTAGTCG GTGGAACATG CCCAACTTAC CTTCCACGAC
3801  TTCCCTGACA CCAAGTAATA TTCCAACAAG TGGTGCCATA GGAAAAAGCA
3851  CCCTGGTTCC CTTGGACACT CCATCTCCAG CCACATCATT GGAGGCATCA
3901  GAAGGGGGAC TTCCAACCCT CAGCACCTAC CCTGAATCAA CAAACACACC
3951  CAGCATCCAC CTCGGAGCAC ACGCTAGTTC AGAAAGTCCA AGCACCATCA
4001  AACTTACCAT GGCTTCAGTA GTAAAACCTG GCTCTTACAC ACCTCTCACC
4051  TTCCCCTCAA TAGAGACCCA CATTCATGTA TCAACAGCCA GAATGGCTTA
4101  CTCTTCTGGG TCTTCACCTG AGATGACAGC TCCTGGAGAG ACTAACACTG
4151  GTAGTACCTG GGACCCCACC ACCTACATCA CCACTACGGA TCCTAAGGAT
4201  ACAAGTTCAG CTCAGGTCTC TACACCCCAC TCAGTGAGGA CACTCAGAAC
4251  CACAGAAAAC CATCCAAAGA CAGAGTCCGC CACCCCAGCT GCTTACTCTG
4301  GAAGTCCTAA AATCTCAAGT TCACCCAATC TCACCAGTCC GGCCACAAAA
4351  GCATGGACCA TCACAGACAC AACTGAACAC TCCACTCAAT TACATTACAC
4401  AAAATTGGCA GAAAAATCAT CTGGATTTGA GACACAGTCA GCTCCAGGAC
4451  CTGTCTCTGT AGTAATCCCT ACCTCCCCTA CCATTGGAAG CAGCACATTG
4501  GAACTAACTT CTGATGTCCC AGGGGAACCC CTGGTCCTTG CTCCCAGTGA
4551  GCAGACCACA ATCACTCTCC CCATGGCAAC ATGGCTGAGT ACCAGTTTGA
4601  CAGAGGAAAT GGCTTCAACA GACCTTGATA TTTCAAGTCC AAGTTCACCC
4651  ATGAGTACAT TTGCTATTTT TCCACCTATG TCCACACCTT CTCATGAACT
4701  TTCAAAGTCA GAGGCAGATA CCAGTGCCAT TAGAAATACA GATTCAACAA
4751  CGTTGGATCA GCACCTAGGA ATCAGGAGTT TGGGCAGAAC TGGGGACTTA
4801  ACAACTGTTC CTATCACCCC ACTGACAACC ACGTGGACCA GTGTGATTGA
4851  ACACTCAACA CAAGCACAGG ACACCCTTTC TGCAACGATG AGTCCTACTC
4901  ACGTGACACA GTCACTCAAA GATCAAACAT CTATACCAGC CTCAGCATCC
```

TABLE 30-continued

Human cDNA of CA125
(SEQ ID NO: 314)

| | |
|---|---|
| 4951 | CCTTCCCATC TTACTGAAGT CTACCCTGAG CTCGGGACAC AAGGGAGAAG |
| 5001 | CTCCTCTGAG GCAACCACTT TTTGGAAACC ATCTACAGAC ACACTGTCCA |
| 5051 | GAGAGATTGA GACTGGCCCA ACAAACATTC AATCCACTCC ACCCATGGAC |
| 5101 | AACACAACAA CAGGGAGCAG TAGTAGTGGA GTCACCCTGG GCATAGCCCA |
| 5151 | CCTTCCCATA GGAACATCCT CCCCAGCTGA GACATCCACA AACATGGCAC |
| 5201 | TGGAAAGAAG AAGTTCTACA GCCACTGTCT CTATGGCTGG ACAATGGGA |
| 5251 | CTCCTTGTTA CTAGTGCTCC AGGAAGAAGC ATCAGCCAGT CATTAGGAAG |
| 5301 | AGTTTCCTCT GTCCTTTCTG AGTCAACTAC TGAAGGAGTC ACAGATTCTA |
| 5351 | GTAAGGGAAG CAGCCCAAGG CTGAACACAC AGGGAAATAC AGCTCTCTCC |
| 5401 | TCCTCTCTTG AACCCAGCTA TGCTGAAGGA AGCCAGATGA GCACAAGCAT |
| 5451 | CCCTCTAACC TCATCTCCTA CAACTCCTGA TGTGGAATTC ATAGGGGGCA |
| 5501 | GCACATTTTG GACCAAGGAG GTCACCACAG TTATGACCTC AGACATCTCC |
| 5551 | AAGTCTTCAG CAAGGACAGA GTCCAGCTCA GCTACCCTTA TGTCCACAGC |
| 5601 | TTTGGGAAGC ACTGAAAATA CAGGAAAAGA AAAACTCAGA ACTGCCTCTA |
| 5651 | TGGATCTTCC ATCTCCAACT CCATCAATGG AGGTGACACC ATGGATTTCT |
| 5701 | CTCACTCTCA GTAATGCCCC CAATACCACA GATTCACTTG ACCTCAGCCA |
| 5751 | TGGGGTGCAC ACCAGCTCTG CAGGGACTTT GGCCACTGAC AGGTCATTGA |
| 5801 | ATACTGGTGT CACTAGAGCC TCCAGATTGG AAAACGGCTC TGATACCTCT |
| 5851 | TCTAAGTCCC TGTCTATGGG AAACAGCACT CACACTTCCA TGACTGACAC |
| 5901 | AGAGAAGAGT GAAGTGTCTT CTTCAATCCA TCCCCGACCT GAGACCTCAG |
| 5951 | CTCCTGGAGC AGAGACCACT TTGACTTCCA CTCCTGGAAA CAGGGCCATA |
| 6001 | AGCTTAACAT TGCCTTTTTC ATCCATTCCA GTGGAAGAAG TCATTTCTAC |
| 6051 | AGGCATAACC TCAGGACCAG ACATCAACTC AGCACCCATG ACACATTCTC |
| 6101 | CCATCACCCC ACCAACAATT GTATGGACCA GTACAGGCAC AATTGAACAG |
| 6151 | TCCACTCAAC CACTACATGC AGTTTCTTCA GAAAAAGTTT CTGTGCAGAC |
| 6201 | ACAGTCAACT CCATATGTCA ACTCTGTGGC AGTGTCTGCT TCCCCTACCC |
| 6251 | ATGAGAATTC AGTCTCTTCT GGAAGCAGCA CATCCTCTCC ATATTCCTCA |
| 6301 | GCCTCACTTG AATCCTTGGA TTCCACAATC AGTAGGAGGA ATGCAATCAC |
| 6351 | TTCCTGGCTA TGGGACCTCA CTACATCTCT CCCCACTACA ACTTGGCCAA |
| 6401 | GTACTAGTTT ATCTGAGGCA CTGTCCTCAG GCCATTCTGG GGTTTCAAAC |
| 6451 | CCAAGTTCAA CTACGACTGA ATTTCCACTC TTTTCAGCTG CATCCACATC |
| 6501 | TGCTGCTAAG CAAAGAAATC CAGAAACAGA GACCCATGGT CCCCAGAATA |
| 6551 | CAGCCGCGAG TACTTTGAAC ACTGATGCAT CCTCGGTCAC AGGTCTTTCT |
| 6601 | GAGACTCCTG TGGGGCAAG TATCAGCTCT GAAGTCCCTC TTCCAATGGC |
| 6651 | CATAACTTCT AGATCAGATG TTTCTGGCCT TACATCTGAG AGTACTGCTA |
| 6701 | ACCCGAGTTT AGGCACAGCC TCTTCAGCAG GACCAAATT AACTAGGACA |
| 6751 | ATATCCCTGC CCACTTCAGA GTCTTTGGTT TCCTTTAGAA TGAACAAGGA |
| 6801 | TCCATGGACA GTGTCAATCC CTTTGGGGTC CCATCCAACT ACTAATACAG |
| 6851 | AAACAAGCAT CCCAGTAAAC AGCGCAGGTC CACCTGGCTT GTCCACAGTA |

TABLE 30-continued

Human cDNA of CA125
(SEQ ID NO: 314)

```
6901   GCATCAGATG TAATTGACAC ACCTTCAGAT GGGGCTGAGA GTATTCCCAC
6951   TGTCTCCTTT TCCCCCTCCC CTGATACTGA AGTGACAACT ATCTCACATT
7001   TCCCAGAAAA GACAACTCAT TCATTTAGAA CCATTTCATC TCTCACTCAT
7051   GAGTTGACTT CAAGAGTGAC ACCTATTCCT GGGGATTGGA TGAGTTCAGC
7101   TATGTCTACA AAGCCCACAG GAGCCAGTCC CTCCATTACA CTGGGAGAGA
7151   GAAGGACAAT CACCTCTGCT GCTCCAACCA CTTCCCCCAT AGTTCTCACT
7201   GCTAGTTTCA CAGAGACCAG CACAGTTTCA CTGGATAATG AAACTACAGT
7251   AAAAACCTCA GATATCCTTG ACGCACGGAA AACAAATGAG CTCCCCTCAG
7301   ATAGCAGTTC TTCTTCTGAT CTGATCAACA CCTCCATAGC TTCTTCAACT
7351   ATGGATGTCA CTAAAACAGC CTCCATCAGT CCCACTAGCA TCTCAGGAAT
7401   GACAGCAAGT TCCTCCCCAT CTCTCTTCTC TTCAGATAGA CCCCAGGTTC
7451   CCACATCTAC AACAGAGACA AATACAGCCA CCTCTCCATC TGTTTCCAGT
7501   AACACCTATT CTCTTGATGG GGGCTCCAAT GTGGGTGGCA CTCCATCCAC
7551   TTTACCACCC TTTACAATCA CCCACCCTGT CGAGACAAGC TCGGCCCTAT
7601   TAGCCTGGTC TAGACCAGTA AGAACTTTCA GCACCATGGT CAGCACTGAC
7651   ACTGCCTCCG GAGAAAATCC TACCTCTAGC AATTCTGTGG TGACTTCTGT
7701   TCCAGCACCA GGTACATGGG CCAGTGTAGG CAGTACTACT GACTTACCTG
7751   CCATGGGCTT TCTCAAGACA AGTCCTGCAG GAGAGGCACA CTCACTTCTA
7801   GCATCAACTA TTGAACCAGC CACTGCCTTC ACTCCCCATC TCTCAGCAGC
7851   AGTGGTCACT GGATCCAGTG CTACATCAGA AGCCAGTCTT CTCACTACGA
7901   GTGAAAGCAA AGCCATTCAT TCTTCACCAC AGACCCCAAC TACACCCACC
7951   TCTGGAGCAA ACTGGGAAAC TTCAGCTACT CCTGAGAGCC TTTTGGTAGT
8001   CACTGAGACT TCAGACACAA CACTTACCTC AAAGATTTTG GTCACAGATA
8051   CCATCTTGTT TTCAACTGTG TCCACGCCAC CTTCTAAATT TCCAAGTACG
8101   GGGACTCTGT CTGGAGCTTC CTTCCCTACT TTACTCCCGG ACACTCCAGC
8151   CATCCCTCTC ACTGCCACTG AGCCAACAAG TTCATTAGCT ACATCCTTTG
8201   ATTCCACCCC ACTGGTGACT ATAGCTTCGG ATAGTCTTGG CACAGTCCCA
8251   GAGACTACCC TGACCATGTC AGAGACCTCA AATGGTGATG CACTGGTTCT
8301   TAAGACAGTA AGTAACCCAG ATAGGAGCAT CCCTGGAATC ACTATCCAAG
8351   GAGTAACAGA AAGTCCACTC CATCCTTCTT CCACTTCCCC CTCTAAGATT
8401   GTTGCTCCAC GGAATACAAC CTATGAAGGT TCGATCACAG TGGCACTTTC
8451   TACTTTGCCT GCGGGAACTA CTGGTTCCCT TGTATTCAGT CAGAGTTCTG
8501   AAAACTCAGA GACAACGGCT TTGGTAGACT CATCAGCTGG GCTTGAGAGG
8551   GCATCTGTGA TGCCACTAAC CACAGGAAGC CAGGGTATGG CTAGCTCTGG
8601   AGGAATCAGA AGTGGGTCCA CTCACTCAAC TGGAACCAAA ACATTTTCTT
8651   CTCTCCCTCT GACCATGAAC CCAGGTGAGG TTACAGCCAT GTCTGAAATC
8701   ACCACGAACA GACTGACAGC TACTCAATCA ACAGCACCCA AAGGGATACC
8751   TGTGAAGCCC ACCAGTGCTG AGTCAGGCCT CCTAACACCT GTCTCTGCCT
```

TABLE 30-continued

Human cDNA of CA125
(SEQ ID NO: 314)

```
 8801  CCTCAAGCCC ATCAAAGGCC TTTGCCTCAC TGACTACAGC TCCCCCATCA
 8851  ACTTGGGGGA TCCCACAGTC TACCTTGACA TTTGAGTTTT CTGAGGTCCC
 8901  AAGTTTGGAT ACTAAGTCCG CTTCTTTACC AACTCCTGGA CAGTCCCTGA
 8951  ACACCATTCC AGACTCAGAT GCAAGCACAG CATCTTCCTC ACTGTCCAAG
 9001  TCTCCAGAAA AAACCCAAG GGCAAGGATG ATGACTTCCA CAAAGGCCAT
 9051  AAGTGCAAGC TCATTTCAAT CAACAGGTTT TACTGAAACC CCTGAGGGAT
 9101  CTGCCTCCCC TTCTATGGCA GGGCATGAAC CCAGAGTCCC CACTTCAGGA
 9151  ACAGGGGACC CTAGATATGC CTCAGAGAGC ATGTCTTATC CAGACCCAAG
 9201  CAAGGCATCA TCAGCTATGA CATCGACCTC TCTTGCATCA AAACTCACAA
 9251  CTCTCTTCAG CACAGGTCAA GCAGCAAGGT CTGGTTCTAG TTCCTCTCCC
 9301  ATAAGCCTAT CCACTGAGAA AGAAACAAGC TTCCTTTCCC CCACTGCATC
 9351  CACCTCCAGA AAGACTTCAC TATTTCTTGG GCCTTCCATG GCAAGGCAGC
 9401  CCAACATATT GGTGCATCTT CAGACTTCAG CTCTGACACT TTCTCCAACA
 9451  TCCACTCTAA ATATGTCCCA GGAGGAGCCT CCTGAGTTAA CCTCAAGCCA
 9501  GACCATTGCA GAAGAAGAGG GAACAACAGC TGAAACACAC ACGTTAACCT
 9551  TCACACCATC TGAGACCCCA ACATCCTTGT TACCTGTCTC TTCTCCCACA
 9601  GAACCCACAG CCAGAAGAAA GAGTTCTCCA GAAACATGGG CAAGCTCTAT
 9651  TTCAGTTCCT GCCAAGACCT CCTTGGTTGA ACAACTGAT GGAACGCTAG
 9701  TGACCACCAT AAAGATGTCA AGCCAGGCAG CACAAGGAA TTCCACGTGG
 9751  CCTGCCCCAG CAGAGGAGAC GGGGACCAGT CCAGCAGGCA CATCCCCAGG
 9801  AAGCCCAGAA GTGTCTACCA CTCTCAAAAT CATGAGCTCC AAGGAACCCA
 9851  GCATCAGCCC AGAGATCAGG TCCACTGTGC GAAATTCTCC TTGGAAGACT
 9901  CCAGAAACAA CTGTTCCCAT GGAGACCACA GTGGAACCAG TCACCCTTCA
 9951  GTCCACAGCC CTAGGAAGTG GCAGCACCAG CATCTCTCAC CTGCCCACAG
10001  GAACCACATC ACCAACCAAG TCACCAACAG AAAATATGTT GGCTACAGAA
10051  AGGGTCTCCC TCTCCCCATC CCCACCTGAG GCTTGGACCA ACTTTATTC
10101  TGGAACTCCA GGAGGGACCA GGCAGTCACT GGCCACAATG TCCTCTGTCT
10151  CCCTAGAGTC ACCAACTGCT AGAAGCATCA CAGGGACTGG TCAGCAAAGC
10201  AGTCCAGAAC TGGTTTCAAA GACAACTGGA ATGGAATTCT CTATGTGGCA
10251  TGGCTCTACT GGAGGGACCA CAGGGGACAC ACATGTCTCT CTGAGCACAT
10301  CTTCCAATAT CCTTGAAGAC CCTGTAACCA GCCCAAACTC TGTGAGCTCA
10351  TTGACAGATA AATCCAAACA TAAAACCGAG ACATGGGTAA GCACCACAGC
10401  CATTCCCTCC ACTGTCCTGA ATAATAAGAT AATGGCAGCT GAACAACAGA
10451  CAAGTCGATC TGTGGATGAG GCTTATTCAT CAACTAGTTC TTGGTCAGAT
10501  CAGACATCTG GGAGTGACAT CACCCTTGGT GCATCTCCTG ATGTCACAAA
10551  CACATTATAC ATCACCTCCA CAGCACAAAC CACCTCACTA GTGTCTCTGC
10601  CCTCTGGAGA CCAAGGCATT ACAAGCCTCA CCAATCCCTC AGGAGGAAAA
10651  ACAAGCTCTG CGTCATCTGT CACATCTCCT TCAATAGGGC TTGAGACTCT
10701  GAGGGCCAAT GTAAGTGCAG TGAAAAGTGA CATTGCCCCT ACTGCTGGGC
```

TABLE 30-continued

Human cDNA of CA125
(SEQ ID NO: 314)

```
10751  ATCTATCTCA GACTTCATCT CCTGCGGAAG TGAGCATCCT GGACGTAACC
10801  ACAGCTCCTA CTCCAGGTAT CTCCACCACC ATCACCACCA TGGGAACCAA
10851  CTCAATCTCA ACTACCACAC CCAACCCAGA AGTGGGTATG AGTACCATGG
10901  ACAGCACCCC GGCCACAGAG AGGCGCACAA CTTCTACAGA ACACCCTTCC
10951  ACCTGGTCTT CCACAGCTGC ATCAGATTCC TGGACTGTCA CAGACATGAC
11001  TTCAAACTTG AAAGTTGCAA GATCTCCTGG AACAATTTCC ACAATGCATA
11051  CAACTTCATT CTTAGCCTCA AGCACTGAAT TAGACTCCAT GTCTACTCCC
11101  CATGGCCGTA TAACTGTCAT TGGAACCAGC CTGGTCACTC CATCCTCTGA
11151  TGCTTCAGCT GTAAAGACAG AGACCAGTAC AAGTGAAAGA ACATTGAGTC
11201  CTTCAGACAC AACTGCATCT ACTCCCATCT CAACTTTTTC TCGTGTCCAG
11251  AGGATGAGCA TCTCAGTTCC TGACATTTTA AGTACAAGTT GGACTCCCAG
11301  TAGTACAGAA GCAGAAGATG TGCCTGTTTC AATGGTTTCT ACAGATCATG
11351  CTAGTACAAA GACTGACCCA ATACGCCCC TGTCCACTTT TCTGTTTGAT
11401  TCTCTGTCCA CTCTTGACTG GGACACTGGG AGATCTCTGT CATCAGCCAC
11451  AGCCACTACC TCAGCTCCTC AGGGGGCCAC AACTCCCCAG GAACTCACTT
11501  TGGAAACCAT GATCAGCCCA GCTACCTCAC AGTTGCCCTT CTCTATAGGG
11551  CACATTACAA GTGCAGTCAC ACCAGCTGCA ATGGCAAGGA GCTCTGGAGT
11601  TACTTTTTCA AGACCAGATC CCACAAGCAA AAAGGCAGAG CAGACTTCCA
11651  CTCAGCTTCC CACCACCACT TCTGCACATC CAGGGCAGGT GCCCAGATCA
11701  GCAGCAACAA CTCTGGATGT GATCCCACAC ACAGCAAAAA CTCCAGATGC
11751  AACTTTTCAG AGACAAGGGC AGACAGCTCT TACAACAGAG GCAAGAGCTA
11801  CATCTGACTC CTGGAATGAG AAAGAAAAAT CAACCCCAAG TGCACCTTGG
11851  ATCACTGAGA TGATGAATTC TGTCTCAGAA GATACCATCA AGGAGGTTAC
11901  CAGCTCCTCC AGTGTATTAA AGGACCCTGA ATACGCTGGA CATAAACTTG
11951  GAATCTGGGA CGACTTCATC CCCAAGTTTG GAAAAGCAGC CCATATGAGA
12001  GAGTTGCCCC TTCTGAGTCC ACCACAGGAC AAAGAGGCAA TTCACCCTTC
12051  TACAAACACA GTAGAGACCA CAGGCTGGGT CACAAGTTCC GAACATGCTT
12101  CTCATTCCAC TATCCCAGCC CACTCAGCGT CATCCAAACT CACATCTCCA
12151  GTGGTTACAA CCTCCACCAG GGAACAAGCA ATAGTTTCTA TGTCAACAAC
12201  CACATGGCCA GAGTCTACAA GGGCTAGAAC AGAGCCTAAT TCCTTCTTGA
12251  CTATTGAACT GAGGGACGTC AGCCCTTACA TGGACACCAG CTCAACCACA
12301  CAAACAAGTA TTATCTCTTC CCCAGGTTCC ACTGCGATCA CCAAGGGGCC
12351  TAGAACAGAA ATTACCTCCT CTAAGAGAAT ATCCAGCTCA TTCCTTGCCC
12401  AGTCTATGAG GTCGTCAGAC AGCCCCTCAG AAGCCATCAC CAGGCTGTCT
12451  AACTTTCCTG CCATGACAGA ATCTGGAGGA ATGATCCTTG CTATGCAAAC
12501  AAGTCCACCT GGCGCTACAT CACTAAGTGC ACCTACTTTG GATACATCAG
12551  CCACAGCCTC CTGGACAGGG ACTCCACTGG CTACGACTCA GAGATTTACA
12601  TACTCAGAGA AGACCACTCT CTTTAGCAAA GGTCCTGAGG ATACATCACA
```

TABLE 30-continued

Human cDNA of CA125
(SEQ ID NO: 314)

```
12651   GCCAAGCCCT CCCTCTGTGG AAGAAACCAG CTCTTCCTCT TCCCTGGTAC
12701   CTATCCATGC TACAACCTCG CCTTCCAATA TTTTGTTGAC ATCACAAGGG
12751   CACAGTCCCT CCTCTACTCC ACCTGTGACC TCAGTTTTCT TGTCTGAGAC
12801   CTCTGGCCTG GGGAAGACCA CAGACATGTC GAGGATAAGC TTGGAACCTG
12851   GCACAAGTTT ACCTCCCAAT TGAGCAGTA CAGCAGGTGA GGCGTTATCC
12901   ACTTATGAAG CCTCCAGAGA TACAAAGGCA ATTCATCATT CTGCAGACAC
12951   AGCAGTGACG AATATGGAGG CAACCAGTTC TGAATATTCT CCTATCCCAG
13001   GCCATACAAA GCCATCCAAA GCCACATCTC CATTGGTTAC CTCCCACATC
13051   ATGGGGACA TCACTTCTTC CACATCAGTA TTTGGCTCCT CCGAGACCAC
13101   AGAGATTGAG ACAGTGTCCT CTGTGAACCA GGGACTTCAG GAGAGAAGCA
13151   CATCCCAGGT GGCCAGCTCT GCTACAGAGA CAAGCACTGT CATTACCCAT
13201   GTGTCTAGTG GTGATGCTAC TACTCATGTC ACCAAGACAC AAGCCACTTT
13251   CTCTAGCGGA ACATCCATCT CAAGCCCTCA TCAGTTTATA ACTTCTACCA
13301   ACACATTTAC AGATGTGAGC ACCAACCCCT CCACCTCTCT GATAATGACA
13351   GAATCTTCAG GAGTGACCAT CACCACCCAA ACAGGTCCTA CTGGAGCTGC
13401   AACACAGGGT CCATATCTCT TGGACACATC AACCATGCCT TACTTGACAG
13451   AGACTCCATT AGCTGTGACT CCAGATTTTA TGCAATCAGA GAAGACCACT
13501   CTCATAAGCA AAGGTCCCAA GGATGTGACC TGGACAAGCC CTCCCTCTGT
13551   GGCAGAAACC AGCTATCCCT CTTCCCTGAC ACCTTTCTTG GTCACAACCA
13601   TACCTCCTGC CACTTCCACG TTACAAGGGC AACATACATC CTCTCCTGTT
13651   TCTGCGACTT CAGTTCTTAC CTCTGGACTG GTGAAGACCA CAGATATGTT
13701   GAACACAAGC ATGGAACCTG TGACCAATTC ACCTCAAAAT TTGAACAATC
13751   CATCAAATGA GATACTGGCC ACTTTGGCAG CCACCACAGA TATAGAGACT
13801   ATTCATCCTT CCATAAACAA AGCAGTGACC AATATGGGGA CTGCCAGTTC
13851   AGCACATGTA CTGCATTCCA CTCTCCCAGT CAGCTCAGAA CCATCTACAG
13901   CCACATCTCC AATGGTTCCT GCCTCCAGCA TGGGGACGC TCTTGCTTCT
13951   ATATCAATAC CTGGTTCTGA GACCACAGAC ATTGAGGGAG AGCCAACATC
14001   CTCCCTGACT GCTGGACGAA AAGAGAACAG CACCCTCCAG GAGATGAACT
14051   CAACTACAGA GTCAAACATC ATCCTCTCCA ATGTGTCTGT GGGGGCTATT
14101   ACTGAAGCCA CAAAAATGGA AGTCCCCTCT TTTGATGCAA CATTCATACC
14151   AACTCCTGCT CAGTCAACAA AGTTCCCAGA TATTTTCTCA GTAGCCAGCA
14201   GTAGACTTTC AAACTCTCCT CCCATGACAA TATCTACCCA CATGACCACC
14251   ACCCAGACAG GGTCTTCTGG AGCTACATCA AAGATTCCAC TTGCCTTAGA
14301   CACATCAACC TTGGAAACCT CAGCAGGGAC TCCATCAGTG GTGACTGAGG
14351   GGTTTGCCCA CTCAAAAATA ACCACTGCAA TGAACAATGA TGTCAAGGAC
14401   GTGTCACAGA CAAACCCTCC CTTTCAGGAT GAAGCCAGCT CTCCCTCTTC
14451   TCAAGCACCT GTCCTTGTCA CAACCTTACC TTCTTCTGTT GCTTTCACAC
14501   CGCAATGGCA CAGTACCTCC TCTCCTGTTT CTATGTCCTC AGTTCTTACT
14551   TCTTCACTGG TAAAGACCGC AGGCAAGGTG GATACAAGCT TAGAAACAGT
```

TABLE 30-continued

Human cDNA of CA125
(SEQ ID NO: 314)

```
14601  GACCAGTTCA CCTCAAAGTA TGAGCAACAC TTTGGATGAC ATATCGGTCA

14651  CTTCAGCAGC CACCACAGAT ATAGAGACAA CGCATCCTTC CATAAACACA

14701  GTAGTTACCA ATGTGGGGAC CACCGGTTCA GCATTTGAAT CACATTCTAC

14751  TGTCTCAGCT TACCCAGAGC CATCTAAAGT CACATCTCCA AATGTTACCA

14801  CCTCCACCAT GGAAGACACC ACAATTTCCC GATCAATACC TAAATCCTCT

14851  AAGACTACAA GAACTGAGAC TGAGACAACT TCCTCCCTGA CTCCTAAACT

14901  GAGGGAGACC AGCATCTCCC AGGAGATCAC CTCGTCCACA GAGACAAGCA

14951  CTGTTCCTTA CAAAGAGCTC ACTGGTGCCA CTACCGAGGT ATCCAGGACA

15001  GATGTCACTT CCTCTAGCAG TACATCCTTC CCTGGCCCTG ATCAGTCCAC

15051  AGTGTCACTA GACATCTCCA CAGAAACCAA CACCAGGCTG TCTACCTCCC

15101  CAATAATGAC AGAATCTGCA GAAATAACCA TCACCACCCA AACAGGTCCT

15151  CATGGGCTA CATCACAGGA TACTTTTACC ATGGACCCAT CAAATACAAC

15201  CCCCCAGGCA GGGATCCACT CAGCTATGAC TCATGGATTT TCACAATTGG

15251  ATGTGACCAC TCTTATGAGC AGAATTCCAC AGGATGTATC ATGGACAAGT

15301  CCTCCCTCTG TGGATAAAAC CAGCTCCCCC TCTTCCTTTC TGTCCTCACC

15351  TGCAATGACC ACACCTTCCC TGATTTCTTC TACCTTACCA GAGGATAAGC

15401  TCTCCTCTCC TATGACTTCA CTTCTCACCT CTGGCCTAGT GAAGATTACA

15451  GACATATTAC GTACACGCTT GGAACCTGTG ACCAGCTCAC TTCCAAATTT

15501  CAGCAGCACC TCAGATAAGA TACTGGCCAC TTCTAAAGAC AGTAAAGACA

15551  CAAAGGAAAT TTTTCCTTCT ATAAACACAG AAGAGACCAA TGTGAAAGCC

15601  AACAACTCTG GACATGAATC CCATTCCCCT GCACTGGCTG ACTCAGAGAC

15651  ACCCAAAGCC ACAACTCAAA TGGTTATCAC CACCACTGTG GGAGATCCAG

15701  CTCCTTCCAC ATCAATGCCA GTGCATGGTT CCTCTGAGAC TACAAACATT

15751  AAGAGAGAGC CAACATATTT CTTGACTCCT AGACTGAGAG AGACCAGTAC

15801  CTCTCAGGAG TCCAGCTTTC CCACGGACAC AAGTTTTCTA CTTTCCAAAG

15851  TCCCCACTGG TACTATTACT GAGGTCTCCA GTACAGGGGT CAACTCTTCT

15901  AGCAAAATTT CCACCCCAGA CCATGATAAG TCCACAGTGC CACCTGACAC

15951  CTTCACAGGA GAGATCCCCA GGGTCTTCAC CTCCTCTATT AAGACAAAAT

16001  CTGCAGAAAT GACGATCACC ACCCAAGCAA GTCCTCCTGA GTCTGCATCG

16051  CACAGTACCC TTCCCTTGGA CACATCAACC ACACTTTCCC AGGGAGGGAC

16101  TCATTCAACT GTGACTCAGG GATTCCCATA CTCAGAGGTG ACCACTCTCA

16151  TGGGCATGGG TCCTGGGAAT GTGTCATGGA TGACAACTCC CCCTGTGGAA

16201  GAAACCAGCT CTGTGTCTTC CCTGATGTCT TCACCTGCCA TGACATCCCC

16251  TTCTCCTGTT TCCTCCACAT CACCACAGAG CATCCCCTCC TCTCCTCTTC

16301  CTGTGACTGC ACTTCCTACT TCTGTTCTGG TGACAACCAC AGATGTGTTG

16351  GGCACAACAA GCCCAGAGTC TGTAACCAGT TCACCTCCAA ATTTGAGCAG

16401  CATCACTCAT GAGAGACCGG CCACTTACAA AGACACTGCA CACACAGAAG

16451  CCGCCATGCA TCATTCCACA AACACCGCAG TGACCAATGT AGGGACTTCC
```

TABLE 30-continued

Human cDNA of CA125
(SEQ ID NO: 314)

```
16501  GGGTCTGGAC ATAAATCACA ATCCTCTGTC CTAGCTGACT CAGAGACATC

16551  GAAAGCCACA CCTCTGATGA GTACCACCTC CACCCTGGGG GACACAAGTG

16601  TTTCCACATC AACTCCTAAT ATCTCTCAGA CTAACCAAAT TCAAACAGAG

16651  CCAACAGCAT CCCTGAGCCC TAGACTGAGG GAGAGCAGCA CGTCTGAGAA

16701  GACCAGCTCA ACAACAGAGA CAAATACTGC CTTTTCTTAT GTGCCCACAG

16751  GTGCTATTAC TCAGGCCTCC AGAACAGAAA TCTCCTCTAG CAGAACATCC

16801  ATCTCAGACC TTGATCGGCC CACAATAGCA CCCGACATCT CCACAGGAAT

16851  GATCACCAGG CTCTTCACCT CCCCCATCAT GACAAAATCT GCAGAAATGA

16901  CCGTCACCAC TCAAACAACT ACTCCTGGGG CTACATCACA GGGTATCCTT

16951  CCTTGGGACA CATCAACCAC ACTTTTCCAG GGAGGGACTC ATTCAACCGT

17001  GTCTCAGGGA TTCCCACACT CAGAGATAAC CACTCTTCGG AGCAGAACCC

17051  CTGGAGATGT GTCATGGATG ACAACTCCCC CTGTGGAAGA AACCAGCTCT

17101  GGGTTTTCCC TGATGTCACC TTCCATGACA TCCCCTTCTC CTGTTTCCTC

17151  CACATCACCA GAGAGCATCC CCTCCTCTCC TCTCCCTGTG ACTGCACTTC

17201  TTACTTCTGT TCTGGTGACA ACCACCAATG TATTGGGCAC AACAAGCCCA

17251  GAGACCGTAA CGAGTTCACC TCCAAATTTA AGCAGCCCCA CACAGGAGAG

17301  ACTGACCACT TACAAAGACA CTGCGCACAC AGAAGCCATG CATGCTTCCA

17351  TGCATACAAA CACTGCAGTG GCCAACGTCG GGACCTCCAT TTCTGGACAT

17401  GAATCACAAT CTTCTGTCCC AGCTGATTCA CACACATCCA AAGCCACATC

17451  TCCAATGGGT ATCACCTTCG CCATGGGGGA TACAAGTGTT CTACATCAA

17501  CTCCTGCCTT CTTTGAGACT AGAATTCAGA CTGAATCAAC ATCCTCTTTG

17551  ATTCCTGGAT TAAGGGACAC CAGGACGTCT GAGGAGATCA ACACTGTGAC

17601  AGAGACCAGC ACTGTCCTTT CAGAAGTGCC CACTACTACT ACTACTGAGG

17651  TCTCCAGGAC AGAAGTTATC ACTTCCAGCA GAACAACCAT CTCAGGGCCT

17701  GATCATTCCA AAATGTCACC CTACATCTCC ACAGAAACCA TCACCAGGCT

17751  CTCCACTTTT CCTTTTGTAA CAGGATCCAC AGAAATGGCC ATCACCAACC

17801  AAACAGGTCC TATAGGGACT ATCTCACAGG CTACCCTTAC CCTGGACACA

17851  TCAAGCACAG CTTCCTGGGA AGGGACTCAC TCACCTGTGA CTCAGAGATT

17901  TCCACACTCA GAGGAGACCA CTACTATGAG CAGAAGTACT AAGGGCGTGT

17951  CATGGCAAAG CCCTCCCTCT GTGGAAGAAA CCAGTTCTCC TTCTTCCCCA

18001  GTGCCTTTAC CTGCAATAAC CTCACATTCA TCTCTTTATT CCGCAGTATC

18051  AGGAAGTAGC CCCACTTCTG CTCTCCCTGT GACTTCCCTT CTCACCTCTG

18101  GCAGGAGGAA GACCATAGAC ATGTTGGACA CACACTCAGA ACTTGTGACC

18151  AGCTCCTTAC CAAGTGCAAG TAGCTTCTCA GGTGAGATAC TCACTTCTGA

18201  AGCCTCCACA AATACAGAGA CAATTCACTT TTCAGAGAAC ACAGCAGAAA

18251  CCAATATGGG GACCACCAAT TCTATGCATA AACTACATTC CTCTGTCTCA

18301  ATCCACTCCC AGCCATCCGG ACACACACCT CCAAAGGTTA CTGGATCTAT

18351  GATGGAGGAC GCTATTGTTT CCACATCAAC ACCTGGTTCT CCTGAGACTA

18401  AAAATGTTGA CAGAGACTCA ACATCCCCTC TGACTCCTGA ACTGAAAGAG
```

TABLE 30-continued

Human cDNA of CA125
(SEQ ID NO: 314)

```
18451   GACAGCACCG CCCTGGTGAT GAACTCAACT ACAGAGTCAA ACACTGTTTT
18501   CTCCAGTGTG TCCCTGGATG CTGCTACTGA GGTCTCCAGG GCAGAAGTCA
18551   CCTACTATGA TCCTACATTC ATGCCAGCTT CTGCTCAGTC AACAAAGTCC
18601   CCAGACATTT CACCTGAAGC CAGCAGCAGT CATTCTAACT CTCCTCCCTT
18651   GACAATATCT ACACACAAGA CCATCGCCAC ACAAACAGGT CCTTCTGGGG
18701   TGACATCTCT TGGCCAACTG ACCCTGGACA CATCAACCAT AGCCACCTCA
18751   GCAGGAACTC CATCAGCCAG AACTCAGGAT TTTGTAGATT CAGAAACAAC
18801   CAGTGTCATG AACAATGATC TCAATGATGT GTTGAAGACA AGCCCTTTCT
18851   CTGCAGAAGA AGCCAACTCT CTCTCTTCTC AGGCACCTCT CCTTGTGACA
18901   ACCTCACCTT CTCCTGTAAC TTCCACATTG CAAGAGCACA GTACCTCCTC
18951   TCTTGTTTCT GTGACCTCAG TACCCACCCC TACACTGGCG AAGATCACAG
19001   ACATGGACAC AAACTTAGAA CCTGTGACTC GTTCACCTCA AAATTTAAGG
19051   AACACCTTGG CCACTTCAGA AGCCACCACA GATACACACA CAATGCATCC
19101   TTCTATAAAC ACAGCAATGG CCAATGTGGG GACCACCAGT TCACCAAATG
19151   AATTCTATTT TACTGTCTCA CCTGACTCAG ACCCATATAA AGCCACATCC
19201   GCAGTAGTTA TCACTTCCAC CTCGGGGGAC TCAATAGTTT CCACATCAAT
19251   GCCTAGATCC TCTGCGATGA AAAGATTGA GTCTGAGACA ACTTTCTCCC
19301   TGATATTTAG ACTGAGGGAG ACTAGCACCT CCCAGAAAAT TGGCTCATCC
19351   TCAGACACAA GCACGGTCTT TGACAAAGCA TTCACTGCTG CTACTACTGA
19401   GGTCTCCAGA ACAGAACTCA CCTCCTCTAG CAGAACATCC ATCCAAGGCA
19451   CTGAAAAGCC CACAATGTCA CCGGACACCT CCACAAGATC TGTCACCATG
19501   CTTTCTACTT TGCTGGCCT GACAAAATCC GAAGAAGGA CCATTGCCAC
19551   CCAAACAGGT CCTCATAGGG CGACATCACA GGGTACCCTT ACCTGGGACA
19601   CATCAATCAC AACCTCACAG GCAGGGACCC ACTCAGCTAT GACTCATGGA
19651   TTTTCACAAT TAGATTTGTC CACTCTTACG AGTAGAGTTC CTGAGTACAT
19701   ATCAGGGACA AGCCCACCCT CTGTGGAAAA AACCAGCTCT TCCTCTTCCC
19751   TTCTGTCTTT ACCAGCAATA ACCTCACCGT CCCCTGTACC TACTACATTA
19801   CCAGAAAGTA GGCCGTCTTC TCCTGTTCAT CTGACTTCAC TCCCCACCTC
19851   TGGCCTAGTG AAGACCACAG ATATGCTGGC ATCTGTGGCC AGTTTACCTC
19901   CAAACTTGGG CAGCACCTCA CATAAGATAC CGACTACTTC AGAAGACATT
19951   AAAGATACAG AGAAAATGTA TCCTTCCACA ACATAGCAG TAACCAATGT
20001   GGGGACCACC ACTTCTGAAA AGGAATCTTA TTCGTCTGTC CCAGCCTACT
20051   CAGAACCACC CAAAGTCACC TCTCCAATGG TTACCTCTTT CAACATAAGG
20101   GACACCATTG TTTCCACATC CATGCCTGGC TCCTCTGAGA TTACAAGGAT
20151   TGAGATGGAG TCAACATTCT CCGTGGCTCA TGGGCTGAAG GGAACCAGCA
20201   CCTCCCAGGA CCCCATCGTA TCCACAGAGA AAAGTGCTGT CCTTCACAAG
20251   TTGACCACTG GTGCTACTGA GACCTCTAGG ACAGAAGTTG CCTCTTCTAG
20301   AAGAACATCC ATTCCAGGCC CTGATCATTC CACAGAGTCA CCAGACATCT
```

TABLE 30-continued

Human cDNA of CA125
(SEQ ID NO: 314)

```
20351  CCACTGAAGT GATCCCCAGC CTGCCTATCT CCCTTGGCAT TACAGAATCT

20401  TCAAATATGA CCATCATCAC TCGAACAGGT CCTCCTCTTG GCTCTACATC

20451  ACAGGGCACA TTTACCTTGG ACACACCAAC TACATCCTCC AGGGCAGGAA

20501  CACACTCGAT GGCGACTCAG GAATTTCCAC ACTCAGAAAT GACCACTGTC

20551  ATGAACAAGG ACCCTGAGAT TCTATCATGG ACAATCCCTC CTTCTATAGA

20601  GAAAACCAGC TTCTCCTCTT CCCTGATGCC TTCACCAGCC ATGACTTCAC

20651  CTCCTGTTTC CTCAACATTA CCAAAGACCA TTCACACCAC TCCTTCTCCT

20701  ATGACCTCAC TGCTCACCCC TAGCCTAGTG ATGACCACAG ACACATTGGG

20751  CACAAGCCCA GAACCTACAA CCAGTTCACC TCCAAATTTG AGCAGTACCT

20801  CACATGTGAT ACTGACAACA GATGAAGACA CCACAGCTAT AGAAGCCATG

20851  CATCCTTCCA CAAGCACAGC AGCGACTAAT GTGGAAACCA CCTGTTCTGG

20901  ACATGGGTCA CAATCCTCTG TCCTAACTGA CTCAGAAAAA ACCAAGGCCA

20951  CAGCTCCAAT GGATACCACC TCCACCATGG GGCATACAAC TGTTTCCACA

21001  TCAATGTCTG TTTCCTCTGA GACTACAAAA ATTAAGAGAG AGTCAACATA

21051  TTCCTTGACT CCTGGACTGA GAGAGACCAG CATTTCCCAA AATGCCAGCT

21101  TTTCCACTGA CACAAGTATT GTTCTTTCAG AAGTCCCCAC TGGTACTACT

21151  GCTGAGGTCT CCAGGACAGA AGTCACCTCC TCTGGTAGAA CATCCATCCC

21201  TGGCCCTTCT CAGTCCACAG TTTTGCCAGA AATATCCACA AGAACAATGA

21251  CAAGGCTCTT TGCCTCGCCC ACCATGACAG AATCAGCAGA AATGACCATC

21301  CCCACTCAAA CAGGTCCTTC TGGGTCTACC TCACAGGATA CCCTTACCTT

21351  GGACACATCC ACCACAAAGT CCCAGGCAAA GACTCATTCA ACTTTGACTC

21401  AGAGATTTCC ACACTCAGAG ATGACCACTC TCATGAGCAG AGGTCCTGGA

21451  GATATGTCAT GGCAAAGCTC TCCCTCTCTG GAAAATCCCA GCTCTCTCCC

21501  TTCCCTGCTG TCTTTACCTG CCACAACCTC ACCTCCTCCC ATTTCCTCCA

21551  CATTACCAGT GACTATCTCC TCCTCTCCTC TTCCTGTGAC TTCACTTCTC

21601  ACCTCTAGCC CGGTAACGAC CACAGACATG TTACACACAA GCCCAGAACT

21651  TGTAACCAGT TCACCTCCAA AGCTGAGCCA CACTTCAGAT GAGAGACTGA

21701  CCACTGGCAA GGACACCACA AATACAGAAG CTGTGCATCC TTCCACAAAC

21751  ACAGCAGCGT CCAATGTGGA GATTCCCAGC TTTGGACATG AATCCCCTTC

21801  CTCTGCCTTA GCTGACTCAG AGACATCCAA AGCCACATCA CCAATGTTTA

21851  TTACCTCCAC CCAGGAGGAT ACAACTGTTG CCATATCAAC CCCTCACTTC

21901  TTGGAGACTA GCAGAATTCA GAAAGAGTCA ATTTCCTCCC TGAGCCCTAA

21951  ATTGAGGGAG ACAGGCAGTT CTGTGGAGAC AAGCTCAGCC ATAGAGACAA

22001  GTGCTGTCCT TTCTGAAGTG TCCATTGGTG CTACTACTGA GATCTCCAGG

22051  ACAGAAGTCA CCTCCTCTAG CAGAACATCC ATCTCTGGTT CTGCTGAGTC

22101  CACAATGTTG CCAGAAATAT CCACCACAAG AAAAATCATT AAGTTCCCTA

22151  CTTCCCCCAT CCTGGCAGAA TCATCAGAAA TGACCATCAA GACCCAAACA

22201  AGTCCTCCTG GGTCTACATC AGAGAGTACC TTTACATTAG ACACATCAAC

22251  CACTCCCTCC TTGGTAATAA CCCATTCGAC TATGACTCAG AGATTGCCAC
```

TABLE 30-continued

Human cDNA of CA125
(SEQ ID NO: 314)

```
22301  ACTCAGAGAT AACCACTCTT GTGAGTAGAG GTGCTGGGGA TGTGCCACGG
22351  CCCAGCTCTC TCCCTGTGGA AGAAACAAGC CCTCCATCTT CCCAGCTGTC
22401  TTTATCTGCC ATGATCTCAC CTTCTCCTGT TTCTTCCACA TTACCAGCAA
22451  GTAGCCACTC CTCTTCTGCT TCTGTGACTT CACCTCTCAC ACCAGGCCAA
22501  GTGAAGACTA CTGAGGTGTT GGACGCAAGT GCAGAACCTG AAACCAGTTC
22551  ACCTCCAAGT TTGAGCAGCA CCTCAGTTGA ATACTGGCC  ACCTCTGAAG
22601  TCACCACAGA TACGGAGAAA ATTCATCCTT TCCCAAACAC GGCAGTAACC
22651  AAAGTTGGAA CTTCCAGTTC TGGACATGAA TCCCCTTCCT CTGTCCTACC
22701  TGACTCAGAG ACAACCAAAG CCACATCGGC AATGGGTACC ATCTCCATTA
22751  TGGGGGATAC AAGTGTTTCT ACATTAACTC CTGCCTTATC TAACACTAGG
22801  AAAATTCAGT CAGAGCCAGC TTCCTCACTG ACCACCAGAT TGAGGGAGAC
22851  CAGCACCTCT GAAGAGACCA GCTTAGCCAC AGAAGCAAAC ACTGTTCTTT
22901  CTAAAGTGTC CACTGGTGCT ACTACTGAGG TCTCCAGGAC AGAAGCCATC
22951  TCCTTTAGCA GAACATCCAT GTCAGGCCCT GAGCAGTCCA CAATGTCACA
23001  AGACATCTCC ATAGGAACCA TCCCCAGGAT TTCTGCCTCC TCTGTCCTGA
23051  CAGAATCTGC AAAAATGACC ATCACAACCC AAACAGGTCC TTCGGAGTCT
23101  ACACTAGAAA GTACCCTTAA TTTGAACACA GCAACCACAC CCTCTTGGGT
23151  GGAAACCCAC TCTATAGTAA TTCAGGGATT TCCACACCCA GAGATGACCA
23201  CTTCCATGGG CAGAGGTCCT GGAGGTGTGT CATGGCCTAG CCCTCCCTTT
23251  GTGAAAGAAA CCAGCCCTCC ATCCTCCCCG CTGTCTTTAC CTGCCGTGAC
23301  CTCACCTCAT CCTGTTTCCA CCACATTCCT AGCACATATC CCCCCCTCTC
23351  CCCTTCCTGT GACTTCACTT CTCACCTCTG GCCCGGCGAC AACCACAGAT
23401  ATCTTGGGTA CAAGCACAGA ACCTGGAACC AGTTCATCTT CAAGTTTGAG
23451  CACCACCTCC CATGAGAGAC TGACCACTTA CAAAGACACT GCACATACAG
23501  AAGCCGTGCA TCCTTCCACA AACACAGGAG GGACCAATGT GGCAACCACC
23551  AGCTCTGGAT ATAAATCACA GTCCTCTGTC CTAGCTGACT CATCTCCAAT
23601  GTGTACCACC TCCACCATGG GGGATACAAG TGTTCTCACA TCAACTCCTG
23651  CCTTCCTTGA GACTAGGAGG ATTCAGACAG AGCTAGCTTC CTCCCTGACC
23701  CCTGGATTGA GGGAGTCCAG TGGCTCTGAA GGGACCAGCT CAGGCACCAA
23751  GATGAGCACT GTCCTCTCTA AAGTGCCCAC TGGTGCTACT ACTGAGATCT
23801  CCAAGGAAGA CGTCACCTCC ATCCCAGGTC CCGCTCAATC CACAATATCA
23851  CCAGACATCT CCACAAGAAC CGTCAGCTGG TTCTCTACAT CCCCTGTCAT
23901  GACAGAATCA GCAGAAATAA CCATGAACAC CCATACAAGT CCTTTAGGGG
23951  CCACAACACA AGGCACCAGT ACTTTGGCCA CGTCAAGCAC AACCTCTTTG
24001  ACAATGACAC ACTCAACTAT ATCTCAAGGA TTTTCACACT CACAGATGAG
24051  CACTCTTATG AGGAGGGGTC CTGAGGATGT ATCATGGATG AGCCCTCCCC
24101  TTCTGGAAAA AACTAGACCT TCCTTTTCTC TGATGTCTTC ACCAGCCACA
24151  ACTTCACCTT CTCCTGTTTC CTCCACATTA CCAGAGAGCA TCTCTTCCTC
```

TABLE 30-continued

Human cDNA of CA125
(SEQ ID NO: 314)

| | |
|---|---|
| 24201 | TCCTCTTCCT GTGACTTCAC TCCTCACGTC TGGCTTGGCA AAAACTACAG |
| 24251 | ATATGTTGCA CAAAAGCTCA GAACCTGTAA CCAACTCACC TGCAAATTTG |
| 24301 | AGCAGCACCT CAGTTGAAAT ACTGGCCACC TCTGAAGTCA CCACAGATAC |
| 24351 | AGAGAAAACT CATCCTTCTT CAAACAGAAC AGTGACCGAT GTGGGGACCT |
| 24401 | CCAGTTCTGG ACATGAATCC ACTTCCTTTG TCCTAGCTGA CTCACAGACA |
| 24451 | TCCAAAGTCA CATCTCCAAT GGTTATTACC TCCACCATGG AGGATACGAG |
| 24501 | TGTCTCCACA TCAACTCCTG GCTTTTTTGA GACTAGCAGA ATTCAGACAG |
| 24551 | AACCAACATC CTCCCTGACC CTTGGACTGA GAAAGACCAG CAGCTCTGAG |
| 24601 | GGGACCAGCT TAGCCACAGA GATGAGCACT GTCCTTTCTG GAGTGCCCAC |
| 24651 | TGGTGCCACT GCTGAAGTCT CCAGGACAGA AGTCACCTCC TCTAGCAGAA |
| 24701 | CATCCATCTC AGGCTTTGCT CAGCTCACAG TGTCACCAGA GACTTCCACA |
| 24751 | GAAACCATCA CCAGACTCCC TACCTCCAGC ATAATGACAG AATCAGCAGA |
| 24801 | AATGATGATC AAGACACAAA CAGATCCTCC TGGGTCTACA CCAGAGAGTA |
| 24851 | CTCATACTGT GGACATATCA ACAACACCCA ACTGGGTAGA AACCCACTCG |
| 24901 | ACTGTGACTC AGAGATTTTC ACACTCAGAG ATGACCACTC TTGTGAGCAG |
| 24951 | AAGCCCTGGT GATATGTTAT GGCCTAGTCA ATCCTCTGTG AAGAAACCA |
| 25001 | GCTCTGCCTC TTCCCTGCTG TCTCTGCCTG CCACGACCTC ACCTTCTCCT |
| 25051 | GTTTCCTCTA CATTAGTAGA GGATTTCCCT TCCGCTTCTC TTCCTGTGAC |
| 25101 | TTCTCTTCTC ACCCCTGGCC TGGTGATAAC CACAGACAGG ATGGGCATAA |
| 25151 | GCAGAGAACC TGGAACCAGT TCCACTTCAA ATTTGAGCAG CACCTCCCAT |
| 25201 | GAGAGACTGA CCACTTTGGA AGACACTGTA GATACAGAAG ACATGCAGCC |
| 25251 | TTCCACACAC ACAGCAGTGA CCAACGTGAG GACCTCCATT TCTGGACATG |
| 25301 | AATCACAATC TTCTGTCCTA TCTGACTCAG AGACACCCAA AGCCACATCT |
| 25351 | CCAATGGGTA CCACCTACAC CATGGGGGAA ACGAGTGTTT CCATATCCAC |
| 25401 | TTCTGACTTC TTTGAGACCA GCAGAATTCA GATAGAACCA ACATCCTCCC |
| 25451 | TGACTTCTGG ATTGAGGGAG ACCAGCAGCT CTGAGAGGAT CAGCTCAGCC |
| 25501 | ACAGAGGGAA GCACTGTCCT TTCTGAAGTG CCCAGTGGTG CTACCACTGA |
| 25551 | GGTCTCCAGG ACAGAAGTGA TATCCTCTAG GGGAACATCC ATGTCAGGGC |
| 25601 | CTGATCAGTT CACCATATCA CCAGACATCT CTACTGAAGC GATCACCAGG |
| 25651 | CTTTCTACTT CCCCCATTAT GACAGAATCA GCAGAAAGTG CCATCACTAT |
| 25701 | TGAGACAGGT TCTCCTGGGG CTACATCAGA GGGTACCCTC ACCTTGGACA |
| 25751 | CCTCAACAAC AACCTTTTGG TCAGGGACCC ACTCAACTGC ATCTCCAGGA |
| 25801 | TTTTCACACT CAGAGATGAC CACTCTTATG AGTAGAACTC CTGGAGATGT |
| 25851 | GCCATGGCCG AGCCTTCCCT CTGTGGAAGA AGCCAGCTCT GTCTCTTCCT |
| 25901 | CACTGTCTTC ACCTGCCATG ACCTCAACTT CTTTTTTCTC CGCATTACCA |
| 25951 | GAGAGCATCT CCTCCTCTCC TCATCCTGTG ACTGCACTTC TCACCCTTGG |
| 26001 | CCCAGTGAAG ACCACAGACA TGTTGCGCAC AAGCTCAGAA CCTGAAACCA |
| 26051 | GTTCACCTCC AAATTTGAGC AGCACCTCAG CTGAAATATT AGCCACGTCT |
| 26101 | GAAGTCACCA AGATAGAGA GAAAATTCAT CCCTCCTCAA ACACACCTGT |

TABLE 30-continued

Human cDNA of CA125
(SEQ ID NO: 314)

```
26151  AGTCAATGTA GGGACTGTGA TTTATAAACA TCTATCCCCT TCCTCTGTTT
26201  TGGCTGACTT AGTGACAACA AAACCCACAT CTCCAATGGC TACCACCTCC
26251  ACTCTGGGGA ATACAAGTGT TTCCACATCA ACTCCTGCCT TCCCAGAAAC
26301  TATGATGACA CAGCCAACTT CCTCCCTGAC TTCTGGATTA AGGGAGATCA
26351  GTACCTCTCA AGAGACCAGC TCAGCAACAG AGAGAAGTGC TTCTCTTTCT
26401  GGAATGCCCA CTGGTGCTAC TACTAAGGTC TCCAGAACAG AAGCCCTCTC
26451  CTTAGGCAGA ACATCCACCC CAGGTCCTGC TCAATCCACA ATATCACCAG
26501  AAATCTCCAC GGAAACCATC ACTAGAATTT CTACTCCCCT CACCACGACA
26551  GGATCAGCAG AAATGACCAT CACCCCCAAA ACAGGTCATT CTGGGGCATC
26601  CTCACAAGGT ACCTTTACCT TGGACACATC AAGCAGAGCC TCCTGGCCAG
26651  GAACTCACTC AGCTGCAACT CACAGATCTC CACACTCAGG GATGACCACT
26701  CCTATGAGCA GAGGTCCTGA GGATGTGTCA TGGCCAAGCC GCCCATCAGT
26751  GGAAAAAACT AGCCCTCCAT CTTCCCTGGT GTCTTTATCT GCAGTAACCT
26801  CACCTTCGCC ACTTTATTCC ACACCATCTG AGAGTAGCCA CTCATCTCCT
26851  CTCCGGGTGA CTTCTCTTTT CACCCCTGTC ATGATGAAGA CCACAGACAT
26901  GTTGGACACA AGCTTGGAAC CTGTGACCAC TTCACCTCCC AGTATGAATA
26951  TCACCTCAGA TGAGAGTCTG GCCACTTCTA AAGCCACCAT GGAGACAGAG
27001  GCAATTCAGC TTTCAGAAAA CACAGCTGTG ACTCAGATGG GCACCATCAG
27051  CGCTAGACAA GAATTCTATT CCTCTTATCC AGGCCTCCCA GAGCCATCCA
27101  AAGTGACATC TCCAGTGGTC ACCTCTTCCA CCATAAAAGA CATTGTTTCT
27151  ACAACCATAC CTGCTTCCTC TGAGATAACA AGAATTGAGA TGGAGTCAAC
27201  ATCCACCCTG ACCCCCACAC CAAGGGAGAC CAGCACCTCC CAGGAGATCC
27251  ACTCAGCCAC AAAGCCAAGC ACTGTTCCTT ACAAGGCACT CACTAGTGCC
27301  ACGATTGAGG ACTCCATGAC ACAAGTCATG TCCTCTAGCA GAGGACCTAG
27351  CCCTGATCAG TCCACAATGT CACAAGACAT ATCCAGTGAA GTGATCACCA
27401  GGCTCTCTAC CTCCCCCATC AAGGCAGAAT CTACAGAAAT GACCATTACC
27451  ACCCAAACAG GTTCTCCTGG GGCTACATCA AGGGGTACCC TTACCTTGGA
27501  CACTTCAACA ACTTTTATGT CAGGGACCCA CTCAACTGCA TCTCAAGGAT
27551  TTTCACACTC ACAGATGACC GCTCTTATGA GTAGAACTCC TGGAGATGTG
27601  CCATGGCTAA GCCATCCCTC TGTGGAAGAA GCCAGCTCTG CCTCTTTCTC
27651  ACTGTCTTCA CCTGTCATGA CCTCATCTTC TCCCGTTTCT TCCACATTAC
27701  CAGACAGCAT CCACTCTTCT TCGCTTCCTG TGACATCACT TCTCACCTCA
27751  GGGCTGGTGA AGACCACAGA GCTGTTGGGC ACAAGCTCAG AACCTGAAAC
27801  CAGTTCACCC CCAAATTTGA GCAGCACCTC AGCTGAAATA CTGGCCACCA
27851  CTGAAGTCAC TACAGATACA GAGAAACTGG AGATGACCAA TGTGGTAACC
27901  TCAGGTTATA CACATGAATC TCCTTCCTCT GTCCTAGCTG ACTCAGTGAC
27951  AACAAAGGCC ACATCTTCAA TGGGTATCAC CTACCCCACA GGAGATACAA
28001  ATGTTCTCAC ATCAACCCCT GCCTTCTCTG ACACCAGTAG GATTCAAACA
```

TABLE 30-continued

Human cDNA of CA125
(SEQ ID NO: 314)

```
28051  AAGTCAAAGC TCTCACTGAC TCCTGGGTTG ATGGAGACCA GCATCTCTGA
28101  AGAGACCAGC TCTGCCACAG AAAAAAGCAC TGTCCTTTCT AGTGTGCCCA
28151  CTGGTGCTAC TACTGAGGTC TCCAGGACAG AAGCCATCTC TTCTAGCAGA
28201  ACATCCATCC CAGGCCCTGC TCAATCCACA ATGTCATCAG ACACCTCCAT
28251  GGAAACCATC ACTAGAATTT CTACCCCCCT CACAAGGAAA GAATCAACAG
28301  ACATGGCCAT CACCCCCAAA ACAGGTCCTT CTGGGGCTAC CTCGCAGGGT
28351  ACCTTTACCT TGGACTCATC AAGCACAGCC TCCTGGCCAG GAACTCACTC
28401  AGCTACAACT CAGAGATTTC CACAGTCAGT GGTGACAACT CCTATGAGCA
28451  GAGGTCCTGA GGATGTGTCA TGGCCAAGCC CGCTGTCTGT GGAAAAAAAC
28501  AGCCCTCCAT CTTCCCTGGT ATCTTCATCT TCAGTAACCT CACCTTCGCC
28551  ACTTTATTCC ACACCATCTG GGAGTAGCCA CTCCTCTCCT GTCCCTGTCA
28601  CTTCTCTTTT CACCTCTATC ATGATGAAGG CCACAGACAT GTTGGATGCA
28651  AGTTTGGAAC CTGAGACCAC TTCAGCTCCC AATATGAATA TCACCTCAGA
28701  TGAGAGTCTG GCCACTTCTA AAGCCACCAC GGAGACAGAG GCAATTCACG
28751  TTTTTGAAAA TACAGCAGCG TCCCATGTGG AAACCACCAG TGCTACAGAG
28801  GAACTCTATT CCTCTTCCCC AGGCTTCTCA GAGCCAACAA AAGTGATATC
28851  TCCAGTGGTC ACCTCTTCCT CTATAAGAGA CAACATGGTT CCACAACAA
28901  TGCCTGGCTC CTCTGGCATT ACAAGGATTG AGATAGAGTC AATGTCATCT
28951  CTGACCCCTG GACTGAGGGA GACCAGAACC TCCCAGGACA TCACCTCATC
29001  CACAGAGACA AGCACTGTCC TTTACAAGAT GTCCTCTGGT GCCACTCCTG
29051  AGGTCTCCAG GACAGAAGTT ATGCCCTCTA GCAGAACATC CATTCCTGGC
29101  CCTGCTCAGT CCACAATGTC ACTAGACATC TCCGATGAAG TTGTCACCAG
29151  GCTGTCTACC TCTCCCATCA TGACAGAATC TGCAGAAATA ACCATCACCA
29201  CCCAAACAGG TTATTCTCTG GCTACATCCC AGGTTACCCT TCCCTTGGGC
29251  ACCTCAATGA CCTTTTTGTC AGGGACCCAC TCAACTATGT CTCAAGGACT
29301  TTCACACTCA GAGATGACCA ATCTTATGAG CAGGGGTCCT GAAAGTCTGT
29351  CATGGACGAG CCCTCGCTTT GTGGAAACAA CTAGATCTTC CTCTTCTCTG
29401  ACATCATTAC CTCTCACGAC CTCACTTTCT CCTGTGTCCT CCACATTACT
29451  AGACAGTAGC CCCTCCTCTC CTCTTCCTGT GACTTCACTT ATCCTCCCAG
29501  GCCTGGTGAA GACTACAGAA GTGTTGGATA CAAGCTCAGA GCCTAAAACC
29551  AGTTCATCTC CAAATTTGAG CAGCACCTCA GTTGAAATAC CGGCCACCTC
29601  TGAAATCATG ACAGATACAG AGAAAATTCA TCCTTCCTCA AACACAGCGG
29651  TGGCCAAAGT GAGGACCTCC AGTTCTGTTC ATGAATCTCA TTCCTCTGTC
29701  CTAGCTGACT CAGAAACAAC CATAACCATA CCTTCAATGG GTATCACCTC
29751  CGCTGTGGAC GATACCACTG TTTTCACATC AAATCCTGCC TTCTCTGAGA
29801  CTAGGAGGAT TCCGACAGAG CCAACATTCT CATTGACTCC TGGATTCAGG
29851  GAGACTAGCA CCTCTGAAGA GACCACCTCA ATCACAGAAA CAAGTGCAGT
29901  CCTTTATGGA GTGCCCACTA GTGCTACTAC TGAAGTCTCC ATGACAGAAA
29951  TCATGTCCTC TAATAGAACA CACATCCCTG ACTCTGATCA GTCCACGATG
```

TABLE 30-continued

Human cDNA of CA125
(SEQ ID NO: 314)

```
30001   TCTCCAGACA TCATCACTGA AGTGATCACC AGGCTCTCTT CCTCATCCAT
30051   GATGTCAGAA TCAACACAAA TGACCATCAC CACCCAAAAA AGTTCTCCTG
30101   GGGCTACAGC ACAGAGTACT CTTACCTTGG CCACAACAAC AGCCCCCTTG
30151   GCAAGGACCC ACTCAACTGT TCCTCCTAGA TTTTTACACT CAGAGATGAC
30201   AACTCTTATG AGTAGGAGTC CTGAAAATCC ATCATGGAAG AGCTCTCCCT
30251   TTGTGGAAAA AACTAGCTCT TCATCTTCTC TGTTGTCCTT ACCTGTCACG
30301   ACCTCACCTT CTGTTTCTTC CACATTACCG CAGAGTATCC CTTCCTCCTC
30351   TTTTTCTGTG ACTTCACTCC TCACCCCAGG CATGGTGAAG ACTACAGACA
30401   CAAGCACAGA ACCTGGAACC AGTTTATCTC CAAATCTGAG TGGCACCTCA
30451   GTTGAAATAC TGGCTGCCTC TGAAGTCACC ACAGATACAG AGAAAATTCA
30501   TCCTTCTTCA AGCATGGCAG TGACCAATGT GGGAACCACC AGTTCTGGAC
30551   ATGAACTATA TTCCTCTGTT TCAATCCACT CGGAGCCATC CAAGGCTACA
30601   TACCCAGTGG GTACTCCCTC TTCCATGGCT GAAACCTCTA TTTCCACATC
30651   AATGCCTGCT AATTTTGAGA CCACAGGATT TGAGGCTGAG CCATTTTCTC
30701   ATTTGACTTC TGGATTTAGG AAGACAAACA TGTCCCTGGA CACCAGCTCA
30751   GTCACACCAA CAAATACACC TTCTTCTCCT GGGTCCACTC ACCTTTTACA
30801   GAGTTCCAAG ACTGATTTCA CCTCTTCTGC AAAAACATCA TCCCCAGACT
30851   GGCCTCCAGC CTCACAGTAT ACTGAAATTC CAGTGGACAT AATCACCCCC
30901   TTTAATGCTT CTCCATCTAT TACGGAGTCC ACTGGGATAA CCTCCTTCCC
30951   AGAATCCAGG TTTACTATGT CTGTAACAGA AAGTACTCAT CATCTGAGTA
31001   CAGATTTGCT GCCTTCAGCT GAGACTATTT CCACTGGCAC AGTGATGCCT
31051   TCTCTATCAG AGGCCATGAC TTCATTTGCC ACCACTGGAG TTCCACGAGC
31101   CATCTCAGGT TCAGGTAGTC CATTCTCTAG GACAGAGTCA GGCCCTGGGG
31151   ATGCTACTCT GTCCACCATT GCAGAGAGCC TGCCTTCATC CACTCCTGTG
31201   CCATTCTCCT CTTCAACCTT CACTACCACT GATTCTTCAA CCATCCCAGC
31251   CCTCCATGAG ATAACTTCCT CTTCAGCTAC CCCATATAGA GTGGACACCA
31301   GTCTTGGGAC AGAGAGCAGC ACTACTGAAG GACGCTTGGT TATGGTCAGT
31351   ACTTTGGACA CTTCAAGCCA ACCAGGCAGG ACATCTTCAA CACCCATTTT
31401   GGATACCAGA ATGACAGAGA GCGTTGAGCT GGGAACAGTG ACAAGTGCTT
31451   ATCAAGTTCC TTCACTCTCA ACACGGTTGA CAAGAACTGA TGGCATTATG
31501   GAACACATCA CAAAAATACC CAATGAAGCA GCACACAGAG GTACCATAAG
31551   ACCAGTCAAA GGCCCTCAGA CATCCACTTC GCCTGCCAGT CCTAAAGGAC
31601   TACACACAGG AGGGACAAAA AGAATGGAGA CCACCACCAC AGCTTTGAAG
31651   ACCACCACCA CAGCTTTGAA GACCACTTCC AGAGCCACCT TGACCACCAG
31701   TGTCTATACT CCCACTTTGG GAACACTGAC TCCCCTCAAT GCATCAAGGC
31751   AAATGGCCAG CACAATCCTC ACAGAAATGA TGATCACAAC CCCATATGTT
31801   TTCCCTGATG TTCCAGAAAC GACATCCTCA TTGGCTACCA GCTGGGAGC
31851   AGAAACCAGC ACAGCTCTTC CCAGGACAAC CCCATCTGTT CTCAATAGAG
```

TABLE 30-continued

Human cDNA of CA125
(SEQ ID NO: 314)

```
31901  AATCAGAGAC CACAGCCTCA CTGGTCTCTC GTTCTGGGGC AGAGAGAAGT
31951  CCGGTTATTC AAACTCTAGA TGTTTCTTCT AGTGAGCCAG ATACAACAGC
32001  TTCATGGGTT ATCCATCCTG CAGAGACCAT CCCAACTGTT TCCAAGACAA
32051  CCCCCAATTT TTTCCACAGT GAATTAGACA CTGTATCTTC CACAGCCACC
32101  AGTCATGGGG CAGACGTCAG CTCAGCCATT CCAACAAATA TCTCACCTAG
32151  TGAACTAGAT GCACTGACCC CACTGGTCAC TATTTCGGGG ACAGATACTA
32201  GTACAACATT CCCAACACTG ACTAAGTCCC ACATGAAAC AGAGACAAGA
32251  ACCACATGGC TCACTCATCC TGCAGAGACC AGCTCAACTA TTCCCAGAAC
32301  AATCCCCAAT TTTTCTCATC ATGAATCAGA TGCCACACCT TCAATAGCCA
32351  CCAGTCCTGG GGCAGAAACC AGTTCAGCTA TTCCAATTAT GACTGTCTCA
32401  CCTGGTGCAG AAGATCTGGT GACCTCACAG GTCACTAGTT CTGGGACAGA
32451  CAGAAATATG ACTATTCCAA CTTTGACTCT TTCTCCTGGT GAACCAAAGA
32501  CGATAGCCTC ATTAGTCACC CATCCTGAAG CACAGACAAG TTCGGCCATT
32551  CCAACTTCAA CTATCTCGCC TGCTGTATCA CGGTTGGTGA CCTCAATGGT
32601  CACCAGTTTG GCGGCAAAGA CAAGTACAAC TAATCGAGCT CTGACAAACT
32651  CCCCTGGTGA ACCAGCTACA ACAGTTTCAT TGGTCACGCA TCCTGCACAG
32701  ACCAGCCCAA CAGTTCCCTG GACAACTTCC ATTTTTTTCC ATAGTAAATC
32751  AGACACCACA CCTTCAATGA CCACCAGTCA TGGGGCAGAA TCCAGTTCAG
32801  CTGTTCCAAC TCCAACTGTT TCAACTGAGG TACCAGGAGT AGTGACCCCT
32851  TTGGTCACCA GTTCTAGGGC AGTGATCAGT ACAACTATTC CAATTCTGAC
32901  TCTTTCTCCT GGTGAACCAG AGACCACACC TTCAATGGCC ACCAGTCATG
32951  GGGAAGAAGC CAGTTCTGCT ATTCCAACTC CAACTGTTTC ACCTGGGGTA
33001  CCAGGAGTGG TGACCTCTCT GGTCACTAGT TCTAGGGCAG TGACTAGTAC
33051  AACTATTCCA ATTCTGACTT TTTCTCTTGG TGAACCAGAG ACCACACCTT
33101  CAATGGCCAC CAGTCATGGG ACAGAAGCTG GCTCAGCTGT TCCAACTGTT
33151  TTACCTGAGG TACCAGGAAT GGTGACCTCT CTGGTTGCTA GTTCTAGGGC
33201  AGTAACCAGT ACAACTCTTC CAACTCTGAC TCTTTCTCCT GGTGAACCAG
33251  AGACCACACC TTCAATGGCC ACCAGTCATG GGGCAGAAGC CAGCTCAACT
33301  GTTCCAACTG TTTCACCTGA GGTACCAGGA GTGGTGACCT CTCTGGTCAC
33351  TAGTTCTAGT GGAGTAAACA GTACAAGTAT TCCAACTCTG ATTCTTTCTC
33401  CTGGTGAACT AGAAACCACA CCTTCAATGG CCACCAGTCA TGGGGCAGAA
33451  GCCAGCTCAG CTGTTCCAAC TCCAACTGTT TCACCTGGGG TATCAGGAGT
33501  GGTGACCCCT CTGGTCACTA GTTCCAGGGC AGTGACCAGT ACAACTATTC
33551  CAATTCTAAC TCTTTCTTCT AGTGAGCCAG AGACCACACC TTCAATGGCC
33601  ACCAGTCATG GGGTAGAAGC CAGCTCAGCT GTTCTAACTG TTTCACCTGA
33651  GGTACCAGGA ATGGTGACCT CTCTGGTCAC TAGTTCTAGA GCAGTAACCA
33701  GTACAACTAT TCCAACTCTG ACTATTTCTT CTGATGAACC AGAGACCACA
33751  ACTTCATTGG TCACCCATTC TGAGGCAAAG ATGATTTCAG CCATTCCAAC
33801  TTTAGCTGTC TCCCCTACTG TACAAGGGCT GGTGACTTCA CTGGTCACTA
```

TABLE 30-continued

Human cDNA of CA125
(SEQ ID NO: 314)

```
33851  GTTCTGGGTC AGAGACCAGT GCGTTTTCAA ATCTAACTGT TGCCTCAAGT
33901  CAACCAGAGA CCATAGACTC ATGGGTCGCT CATCCTGGGA CAGAAGCAAG
33951  TTCTGTTGTT CCAACTTTGA CTGTCTCCAC TGGTGAGCCG TTTACAAATA
34001  TCTCATTGGT CACCCATCCT GCAGAGAGTA GCTCAACTCT TCCCAGGACA
34051  ACCTCAAGGT TTTCCCACAG TGAATTAGAC ACTATGCCTT CTACAGTCAC
34101  CAGTCCTGAG GCAGAATCCA GCTCAGCCAT TTCAACTACT ATTTCACCTG
34151  GTATACCAGG TGTGCTGACA TCACTGGTCA CTAGCTCTGG GAGAGACATC
34201  AGTGCAACTT TTCCAACAGT GCCTGAGTCC CCACATGAAT CAGAGGCAAC
34251  AGCCTCATGG GTTACTCATC CTGCAGTCAC CAGCACAACA GTTCCCAGGA
34301  CAACCCCTAA TTATTCTCAT AGTGAACCAG ACACCACACC ATCAATAGCC
34351  ACCAGTCCTG GGGCAGAAGC CACTTCAGAT TTTCCAACAA TAACTGTCTC
34401  ACCTGATGTA CCAGATATGG TAACCTCACA GGTCACTAGT TCTGGGACAG
34451  ACACCAGTAT AACTATTCCA ACTCTGACTC TTTCTTCTGG TGAGCCAGAG
34501  ACCACAACCT CATTTATCAC CTATTCTGAG ACACACACAA GTTCAGCCAT
34551  TCCAACTCTC CCTGTCTCCC CTGGTGCATC AAAGATGCTG ACCTCACTGG
34601  TCATCAGTTC TGGGACAGAC AGCACTACAA CTTTCCCAAC ACTGACGGAG
34651  ACCCCATATG AACCAGAGAC AACAGCCATA CAGCTCATTC ATCCTGCAGA
34701  GACCAACACA ATGGTTCCCA AGACAACTCC CAAGTTTTCC CATAGTAAGT
34751  CAGACACCAC ACTCCCAGTA GCCATCACCA GTCCTGGGCC AGAAGCCAGT
34801  TCAGCTGTTT CAACGACAAC TATCTCACCT GATATGTCAG ATCTGGTGAC
34851  CTCACTGGTC CCTAGTTCTG GGACAGACAC CAGTACAACC TTCCCAACAT
34901  TGAGTGAGAC CCCATATGAA CCAGAGACTA CAGTCACGTG GCTCACTCAT
34951  CCTGCAGAAA CCAGCACAAC GGTTTCTGGG ACAATTCCCA ACTTTTCCCA
35001  TAGGGGATCA GACACTGCAC CCTCAATGGT CACCAGTCCT GGAGTAGACA
35051  CGAGGTCAGG TGTTCCAACT ACAACCATCC CACCCAGTAT ACCAGGGGTA
35101  GTGACCTCAC AGGTCACTAG TTCTGCAACA GACACTAGTA CAGCTATTCC
35151  AACTTTGACT CCTTCTCCTG GTGAACCAGA GACCACAGCC TCATCAGCTA
35201  CCCATCCTGG GACACAGACT GGCTTCACTG TTCCAATTCG GACTGTTCCC
35251  TCTAGTGAGC CAGATACAAT GGCTTCCTGG GTCACTCATC CTCCACAGAC
35301  CAGCACACCT GTTTCCAGAA CAACCTCCAG TTTTTCCCAT AGTAGTCCAG
35351  ATGCCACACC TGTAATGGCC ACCAGTCCTA GGACAGAAGC CAGTTCAGCT
35401  GTACTGACAA CAATCTCACC TGGTGCACCA GAGATGGTGA CTTCACAGAT
35451  CACTAGTTCT GGGGCAGCAA CCAGTACAAC TGTTCCAACT TTGACTCATT
35501  CTCCTGGTAT GCCAGAGACC ACAGCCTTAT TGAGCACCCA TCCCAGAACA
35551  GGGACAAGTA AAACATTTCC TGCTTCAACT GTGTTTCCTC AAGTATCAGA
35601  GACCACAGCC TCACTCACCA TTAGACCTGG TGCAGAGACT AGCACAGCTC
35651  TCCCAACTCA GACAACATCC TCTCTCTTCA CCCTACTTGT AACTGGAACC
35701  AGCAGAGTTG ATCTAAGTCC AACTGCTTCA CCTGGTGTTT CTGCAAAAAC
```

TABLE 30-continued

Human cDNA of CA125
(SEQ ID NO: 314)

| | |
|---|---|
| 35751 | AGCCCCACTT TCCACCCATC CAGGGACAGA GACCAGCACA ATGATTCCAA |
| 35801 | CTTCAACTCT TTCCCTTGGT TTACTAGAGA CTACAGGCTT ACTGGCCACC |
| 35851 | AGCTCTTCAG CAGAGACCAG CACGAGTACT CTAACTCTGA CTGTTTCCCC |
| 35901 | TGCTGTCTCT GGGCTTTCCA GTGCCTCTAT AACAACTGAT AAGCCCCAAA |
| 35951 | CTGTGACCTC CTGGAACACA GAAACCTCAC CATCTGTAAC TTCAGTTGGA |
| 36001 | CCCCCAGAAT TTTCCAGGAC TGTCACAGGC ACCACTATGA CCTTGATACC |
| 36051 | ATCAGAGATG CCAACACCAC CTAAAACCAG TCATGGAGAA GGAGTGAGTC |
| 36101 | CAACCACTAT CTTGAGAACT ACAATGGTTG AAGCCACTAA TTTAGCTACC |
| 36151 | ACAGGTTCCA GTCCCACTGT GGCCAAGACA ACAACCACCT TCAATACACT |
| 36201 | GGCTGGAAGC CTCTTTACTC CTCTGACCAC ACCTGGGATG TCCACCTTGG |
| 36251 | CCTCTGAGAG TGTGACCTCA AGAACAAGTT ATAACCATCG GTCCTGGATC |
| 36301 | TCCACCACCA GCAGTTATAA CCGTCGGTAC TGGACCCCTG CCACCAGCAC |
| 36351 | TCCAGTGACT TCTACATTCT CCCCAGGGAT TTCCACATCC TCCATCCCCA |
| 36401 | GCTCCACAGC AGCCACAGTC CCATTCATGG TGCCATTCAC CCTCAACTTC |
| 36451 | ACCATCACCA ACCTGCAGTA CGAGGAGGAC ATGCGGCACC CTGGTTCCAG |
| 36501 | GAAGTTCAAC GCCACAGAGA GAGAACTGCA GGGTCTGCTC AAACCCTTGT |
| 36551 | TCAGGAATAG CAGTCTGGAA TACCTCTATT CAGGCTGCAG ACTAGCCTCA |
| 36601 | CTCAGGCCAG AGAAGGATAG CTCAGCCATG GCAGTGGATG CCATCTGCAC |
| 36651 | ACATCGCCCT GACCCTGAAG ACCTCGGACT GGACAGAGAG CGACTGTACT |
| 36701 | GGGAGCTGAG CAATCTGACA AATGGCATCC AGGAGCTGGG CCCCTACACC |
| 36751 | CTGGACCGGA ACAGTCTCTA TGTCAATGGT TTCACCCATC GAAGCTCTAT |
| 36801 | GCCCACCACC AGCACTCCTG GGACCTCCAC AGTGGATGTG GGAACCTCAG |
| 36851 | GGACTCCATC CTCCAGCCCC AGCCCCACGG CTGCTGGCCC TCTCCTGATG |
| 36901 | CCGTTCACCC TCAACTTCAC CATCACCAAC CTGCAGTACG AGGAGGACAT |
| 36951 | GCGTCGCACT GGCTCCAGGA AGTTCAACAC CATGGAGAGT GTCCTGCAGG |
| 37001 | GTCTGCTCAA GCCCTTGTTC AAGAACACCA GTGTTGGCCC TCTGTACTCT |
| 37051 | GGCTGCAGAT TGACCTTGCT CAGGCCCGAG AAAGATGGGG CAGCCACTGG |
| 37101 | AGTGGATGCC ATCTGCACCC ACCGCCTTGA CCCCAAAAGC CCTGGACTCA |
| 37151 | ACAGGGAGCA GCTGTACTGG GAGCTAAGCA AACTGACCAA TGACATTGAA |
| 37201 | GAGCTGGGCC CCTACACCCT GGACAGGAAC AGTCTCTATG TCAATGGTTT |
| 37251 | CACCCATCAG AGCTCTGTGT CCACCACCAG CACTCCTGGG ACCTCCACAG |
| 37301 | TGGATCTCAG AACCTCAGGG ACTCCATCCT CCCTCTCCAG CCCCACAATT |
| 37351 | ATGGCTGCTG GCCCTCTCCT GGTACCATTC ACCCTCAACT TCACCATCAC |
| 37401 | CAACCTGCAG TATGGGGAGG ACATGGGTCA CCCTGGCTCC AGGAAGTTCA |
| 37451 | ACACCACAGA GAGGGTCCTG CAGGGTCTGC TTGGTCCCAT ATTCAAGAAC |
| 37501 | ACCAGTGTTG GCCCTCTGTA CTCTGGCTGC AGACTGACCT CTCTCAGGTC |
| 37551 | TGAGAAGGAT GGAGCAGCCA CTGGAGTGGA TGCCATCTGC ATCCATCATC |
| 37601 | TTGACCCCAA AAGCCCTGGA CTCAACAGAG AGCGGCTGTA CTGGGAGCTG |
| 37651 | AGCCAACTGA CCAATGGCAT CAAAGAGCTG GGCCCCTACA CCCTGGACAG |

TABLE 30-continued

Human cDNA of CA125
(SEQ ID NO: 314)

```
37701  GAACAGTCTC TATGTCAATG GTTTCACCCA TCGGACCTCT GTGCCCACCA
37751  CCAGCACTCC TGGGACCTCC ACAGTGGACC TTGAACCTC AGGGACTCCA
37801  TTCTCCCTCC CAAGCCCCGC AACTGCTGGC CCTCTCCTGG TGCTGTTCAC
37851  CCTCAACTTC ACCATCACCA ACCTGAAGTA TGAGGAGGAC ATGCATCGCC
37901  CTGGCTCCAG GAAGTTCAAC ACCACTGAGA GGGTCCTGCA GACTCTGCTT
37951  GGTCCTATGT TCAAGAACAC CAGTGTTGGC CTTCTGTACT CTGGCTGCAG
38001  ACTGACCTTG CTCAGGTCCG AGAAGGATGG AGCAGCCACT GGAGTGGATG
38051  CCATCTGCAC CCACCGTCTT GACCCCAAAA GCCCTGGACT GGACAGAGAG
38101  CAGCTATACT GGGAGCTGAG CCAGCTGACC AATGGCATCA AAGAGCTGGG
38151  CCCCTACACC CTGGACAGGA ACAGTCTCTA TGTCAATGGT TTCACCCATT
38201  GGATCCCTGT GCCCACCAGC AGCACTCCTG GGACCTCCAC AGTGGACCTT
38251  GGGTCAGGGA CTCCATCCTC CCTCCCCAGC CCCACAGCTG CTGGCCCTCT
38301  CCTGGTGCCA TTCACCCTCA ACTTCACCAT CACCAACCTG CAGTACGAGG
38351  AGGACATGCA TCACCCAGGC TCCAGGAAGT CAACACCAC GGAGCGGGTC
38401  CTGCAGGGTC TGCTTGGTCC CATGTTCAAG AACACCAGTG TCGGCCTTCT
38451  GTACTCTGGC TGCAGACTGA CCTTGCTCAG GTCCGAGAAG GATGGAGCAG
38501  CCACTGGAGT GGATGCCATC TGCACCCACC GTCTTGACCC CAAAAGCCCT
38551  GGAGTGGACA GGGAGCAGCT ATACTGGGAG CTGAGCCAGC TGACCAATGG
38601  CATCAAAGAG CTGGGTCCCT ACACCCTGGA CAGAAACAGT CTCTATGTCA
38651  ATGGTTTCAC CCATCAGACC TCTGCGCCCA ACACCAGCAC TCCTGGGACC
38701  TCCACAGTGG ACCTTGGGAC CTCAGGGACT CCATCCTCCC TCCCCAGCCC
38751  TACATCNGCT GGCCCTCTCC TGGTNCCNTT CACCCTCAAC TTCACCATCA
38801  CCAACCTGCA GTACGAGGAG GACATGCGGC ACCCNGGNTC CAGGAAGTTC
38851  AACACCACNG AGAGGGTNCT GCAGGGTCTG CTNAAGCCCC TNTTCAAGAG
38901  CACCAGTGTT GGCCCTCTGT ACTCTGGCTG CAGACTGACC TTGCTCAGGT
38951  CCGAGAAGGA TGGAGCAGCC ACTGGAGTGG ATGCCATCTG CACCCACCGT
39001  CTTGACCCCA AAAGCCCTGG AGTGGACAGG GAGCAGCTAT ACTGGGAGCT
39051  GAGCCAGCTG ACCAATGGCA TCAAAGAGCT GGGTCCCTAC ACCCTGGACA
39101  GAAACAGTCT CTATGTCAAT GGTTTCACCC ATCAGACCTC TGCGCCCAAC
39151  ACCAGCACTC CTGGGACCTC ACAGTGGAC CTTGGGACCT CAGGGACTCC
39201  ATCCTCCCTC CCCAGCCCTA CATCTGCTGG CCCTCTCCTG GTGCCATTCA
39251  CCCTCAACTT CACCATCACC AACCTGCAGT ACGAGGAGGA CATGCATCAC
39301  CCAGGCTCCA GGAAGTTCAA CACCACGGAG CGGGTCCTGC AGGGTCTGCT
39351  TGGTCCCATG TTCAAGAACA CCAGTGTCGG CCTTCTGTAC TCTGGCTGCA
39401  GACTGACCTT GCTCAGGCCT GAGAAGAATG GGCAGCCAC TGGAATGGAT
39451  GCCATCTGCA GCCACCGTCT TGACCCCAAA AGCCCTGGAC TCAACAGAGA
39501  GCAGCTGTAC TGGGAGCTGA GCCAGCTGAC CCATGGCATC AAAGAGCTGG
39551  GCCCCTACAC CCTGGACAGG AACAGTCTCT ATGTCAATGG TTTCACCCAT
```

TABLE 30-continued

Human cDNA of CA125
(SEQ ID NO: 314)

| | |
|---|---|
| 39601 | CGGAGCTCTG TGGCCCCCAC CAGCACTCCT GGGACCTCCA CAGTGGACCT |
| 39651 | TGGGACCTCA GGGACTCCAT CCTCCCTCCC CAGCCCACA ACAGCTGTTC |
| 39701 | CTCTCCTGGT GCCGTTCACC CTCAACTTTA CCATCACCAA TCTGCAGTAT |
| 39751 | GGGGAGGACA TGCGTCACCC TGGCTCCAGG AAGTTCAACA CCACAGAGAG |
| 39801 | GGTCCTGCAG GGTCTGCTTG GTCCCTTGTT CAAGAACTCC AGTGTCGGCC |
| 39851 | CTCTGTACTC TGGCTGCAGA CTGATCTCTC TCAGGTCTGA GAAGGATGGG |
| 39901 | GCAGCCACTG GAGTGGATGC CATCTGCACC CACCACCTTA ACCCTCAAAG |
| 39951 | CCCTGGACTG GACAGGGAGC AGCTGTACTG GCAGCTGAGC CAGATGACCA |
| 40001 | ATGGCATCAA GAGCTGGGC CCCTACACCC TGGACCGGAA CAGTCTCTAC |
| 40051 | GTCAATGGTT TCACCCATCG GAGCTCTGGG CTCACCACCA GCACTCCTTG |
| 40101 | GACTTCCACA GTTGACCTTG GAACCTCAGG GACTCCATCC CCCGTCCCCA |
| 40151 | GCCCCACAAC TGCTGGCCCT CTCCTGGTGC CATTCACCCT CAACTTCACC |
| 40201 | ATCACCAACC TGCAGTATGA GGAGGACATG CATCGCCCTG GATCTAGGAA |
| 40251 | GTTCAACACC ACAGAGAGGG TCCTGCAGGG TCTGCTTAGT CCCATTTTCA |
| 40301 | AGAACTCCAG TGTTGGCCCT CTGTACTCTG GCTGCAGACT GACCTCTCTC |
| 40351 | AGGCCCGAGA AGGATGGGGC AGCAACTGGA ATGGATGCTG TCTGCCTCTA |
| 40401 | CCACCCTAAT CCCAAAAGAC CTGGACTGGA CAGAGAGCAG CTGTACTGGG |
| 40451 | AGCTAAGCCA GCTGACCCAC AACATCACTG AGCTGGGCCC CTACAGCCTG |
| 40501 | GACAGGGACA GTCTCTATGT CAATGGTTTC ACCCATCAGA ACTCTGTGCC |
| 40551 | CACCACCAGT ACTCCTGGGA CCTCCACAGT GTACTGGGCA CCACTGGGA |
| 40601 | CTCCATCCTC CTTCCCCGGC CACACAGAGC CTGGCCCTCT CCTGATACCA |
| 40651 | TTCACTTTCA ACTTTACCAT CACCAACCTG CATTATGAGG AAAACATGCA |
| 40701 | ACACCCTGGT TCCAGGAAGT TCAACACCAC GGAGAGGGTT CTGCAGGGTC |
| 40751 | TGCTCAAGCC CTTGTTCAAG AACACCAGTG TTGGCCCTCT GTACTCTGGC |
| 40801 | TGCAGACTGA CCTCTCTCAG GCCCGAGAAG GATGGGCAG CAACTGGAAT |
| 40851 | GGATGCTGTC TGCCTCTACC ACCCTAATCC CAAAAGACCT GGGCTGGACA |
| 40901 | GAGAGCAGCT GTACTGGGAG CTAAGCCAGC TGACCCACAA CATCACTGAG |
| 40951 | CTGGGCCCCT ACAGCCTGGA CAGGGACAGT CTCTATGTCA ATGGTTTCAC |
| 41001 | CCATCAGAAC TCTGTGCCCA CCACCAGTAC TCCTGGGACC TCCACAGTGT |
| 41051 | ACTGGGCAAC CACTGGGACT CCATCCTCCT TCCCCGGCCA CACAGAGCCT |
| 41101 | GGCCCTCTCC TGATACCATT CACTTTCAAC TTTACCATCA CCAACCTGCA |
| 41151 | TTATGAGGAA AACATGCAAC ACCCTGGTTC CAGGAAGTTC AACACCACGG |
| 41201 | AGAGGGTTCT GCAGGGTCTG CTCAAGCCCT TGTTCAAGAA CACCAGTGTT |
| 41251 | GGCCCTCTGT ACTCTGGCTG CAGACTGACC TTGCTCAGAC CTGAGAAGCA |
| 41301 | TGAGGCAGCC ACTGGAGTGG ACACCATCTG TACCCACCGC GTTGATCCCA |
| 41351 | TCGGACCTGG ACTGGACAGG GAGCGGCTAT ACTGGGAGCT GAGCCAGCTG |
| 41401 | ACCAACAGCA TTACCGAACT GGGACCCTAC ACCCTGGACA GGGACAGTCT |
| 41451 | CTATGTCAAT GGCTTCAACC CTCGGAGCTC TGTGCCAACC ACCAGCACTC |
| 41501 | CTGGGACCTC CACAGTGCAC CTGGCAACCT CTGGGACTCC ATCCTCCCTG |

TABLE 30-continued

Human cDNA of CA125
(SEQ ID NO: 314)

```
41551   CCTGGCCACA CAGCCCCTGT CCCTCTCTTG ATACCATTCA CCCTCAACTT

41601   TACCATCACC AACCTGCATT ATGAGGAAAA CATGCAACAC CCTGGTTCCA

41651   GGAAGTTCAA CACCACGGAG AGGGTTCTGC AGGGTCTGCT CAAGCCCTTG

41701   TTCAAGAACA CCAGTGTTGG CCCTCTGTAC TCTGGCTGCA GACTGACCTT

41751   GCTCAGACCT GAGAAGCATG AGGCAGCCAC TGGAGTGGAC ACCATCTGTA

41801   CCCACCGCGT TGATCCCATC GGACCTGGAC TGNACAGNGA GCNGCTNTAC

41851   TGGGAGCTNA GCCANCTGAC CAANNNCATC NNNGAGCTGG GNCCCTACAC

41901   CCTGGACAGG NACAGTCTCT ATGTCAATGG TTTCACCCAT CNGANCTCTG

41951   NGCCCACCAC CAGCACTCCT GGGACCTCCA CAGTGNACNT NGGNACCTCN

42001   GGGACTCCAT CCTCCNTCCC CNGCCNCACA TCTGCTGGCC CTCTCCTGGT

42051   GCCATTCACC CTCAACTTCA CCATCACCAA CCTGCAGTAC GAGGAGGACA

42101   TGCATCACCC AGGCTCCAGG AAGTTCAACA CCACGGAGCG GGTCCTGCAG

42151   GGTCTGCTTG GTCCCATGTT CAAGAACACC AGTGTCGGCC TTCTGTACTC

42201   TGGCTGCAGA CTGACCTTGC TCAGGCCTGA GAAGAATGGG GCAGCCACTG

42251   GAATGGATGC CATCTGCAGC CACCGTCTTG ACCCCAAAAG CCCTGGACTC

42301   GACAGAGAGC AGCTGTACTG GGAGCTGAGC CAGCTGACCC ATGGCATCAA

42351   AGAGCTGGGC CCCTACACCC TGGACAGGAA CAGTCTCTAT GTCAATGGTT

42401   TCACCCATCG GAGCTCTGTG GCCCCCACCA GCACTCCTGG GACCTCCACA

42451   GTGGACCTTG GGACCTCAGG GACTCCATCC TCCCTCCCCA GCCCCACAAC

42501   AGCTGTTCCT CTCCTGGTGC CGTTCACCCT CAACTTTACC ATCACCAATC

42551   TGCAGTATGG GGAGGACATG CGTCACCCTG GCTCCAGGAA GTTCAACACC

42601   ACAGAGAGGG TCCTGCAGGG TCTGCTTGGT CCCTTGTTCA AGAACTCCAG

42651   TGTCGGCCCT CTGTACTCTG GCTGCAGACT GATCTCTCTC AGGTCTGAGA

42701   AGGATGGGGC AGCCACTGGA GTGGATGCCA TCTGCACCCA CCACCTTAAC

42751   CCTCAAAGCC CTGGACTGGA CAGGGAGCAG CTGTACTGGC AGCTGAGCCA

42801   GATGACCAAT GGCATCAAAG AGCTGGGCCC CTACACCCTG GACCGGAACA

42851   GTCTCTACGT CAATGGTTTC ACCCATCGGA GCTCTGGGCT CACCACCAGC

42901   ACTCCTTGGA CTTCCACAGT TGACCTTGGA ACCTCAGGGA CTCCATCCCC

42951   CGTCCCCAGC CCCACAACTG CTGGCCCTCT CCTGGTGCCA TTCACCCTAA

43001   ACTTCACCAT CACCAACCTG CAGTATGAGG AGGACATGCA TCGCCCTGGA

43051   TCTAGGAAGT TCAACGCCAC AGAGAGGGTC CTGCAGGGTC TGCTTAGTCC

43101   CATATTCAAG AACTCCAGTG TTGGCCCTCT GTACTCTGGC TGCAGACTGA

43151   CCTCTCTCAG GCCCGAGAAG GATGGGCAG CAACTGGAAT GGATGCTGTC

43201   TGCCTCTACC ACCCTAATCC CAAAAGACCT GGACTGGACA GAGAGCAGCT

43251   GTACTGGGAG CTAAGCCAGC TGACCCACAA CATCACTGAG CTGGGCCCCT

43301   ACAGCCTGGA CAGGGACAGT CTCTATGTCA ATGGTTTCAC CCATCAGAGC

43351   TCTATGACGA CCACCAGAAC TCCTGATACC TCCACAATGC ACCTGGCAAC

43401   CTCGAGAACT CCAGCCTCCC TGTCTGGACC TACGACCGCC AGCCCTCTCC
```

TABLE 30-continued

Human cDNA of CA125
(SEQ ID NO: 314)

```
43451  TGGTGCTATT CACAATCAAC TGCACCATCA CCAACCTGCA GTACGAGGAG
43501  GACATGCGTC GCACTGGCTC CAGGAAGTTC AACACCATGG AGAGTGTCCT
43551  GCAGGGTCTG CTCAAGCCCT TGTTCAAGAA CACCAGTGTT GGCCCTCTGT
43601  ACTCTGGCTG CAGATTGACC TTGCTCAGGC CAAGAAAGA TGGGGCAGCC
43651  ACTGGAGTGG ATGCCATCTG CACCCACCGC CTTGACCCCA AAAGCCCTGG
43701  ACTCAACAGG GAGCAGCTGT ACTGGGAGCT AAGCAAACTG ACCAATGACA
43751  TTGAAGAGCT GGGCCCCTAC ACCCTGGACA GGAACAGTCT CTATGTCAAT
43801  GGTTTCACCC ATCAGAGCTC TGTGTCCACC ACCAGCACTC CTGGGACCTC
43851  CACAGTGGAT CTCAGAACCT CAGGGACTCC ATCCTCCCTC TCCAGCCCCA
43901  CAATTATGNC NNCTGNCCCT CTCCTGNTNC CNTTCACCNT CAACTTNACC
43951  ATCACCAACC TGCANTANGN GGANNACATG CNNCNCCCNG GNTCCAGGAA
44001  GTTCAACACC ACNGAGAGGG TCCTACAGGG TCTGCTCAGG CCCTTGTTCA
44051  AGAACACCAG TGTCAGCTCT CTGTACTCTG GTTGCAGACT GACCTTGCTC
44101  AGGCCTGAGA AGGATGGGGC AGCCACCAGA GTGGATGCTG CCTGCACCTA
44151  CCGCCCTGAT CCCAAAAGCC CTGGACTGGA CAGAGAGCAA CTATACTGGG
44201  AGCTGAGCCA GCTAACCCAC AGCATCACTG AGCTGGGACC CTACACCCTG
44251  GACAGGGTCA GTCTCTATGT CAATGGCTTC AACCCTCGGA GCTCTGTGCC
44301  AACCACCAGC ACTCCTGGGA CCTCCACAGT GCACCTGGCA ACCTCTGGGA
44351  CTCCATCCTC CCTGCCTGGC CACACANCNN CTGNCCCTCT CCTGNTNCCN
44401  TTCACCNTCA ACTTNACCAT CACCAACCTG CANTANGNGG ANNACATGCN
44451  NCNCCCNGGN TCCAGGAAGT TCAACACCAC NGAGAGGGTT CTGCAGGGTC
44501  TGCTCAAACC CTTGTTCAGG AATAGCAGTC TGGAATACCT CTATTCAGGC
44551  TGCAGACTAG CCTCACTCAG GCCAGAGAAG GATAGCTCAG CCATGGCAGT
44601  GGATGCCATC TGCACACATC GCCCTGACCC TGAAGACCTC GGACTGGACA
44651  GAGAGCGACT GTACTGGGAG CTGAGCAATC TGACAAATGG CATCCAGGAG
44701  CTGGGCCCCT ACACCCTGGA CCGGAACAGT CTCTACGTCA ATGGTTTCAC
44751  CCATCGGAGC TCTGGGCTCA CCACCAGCAC TCCTTGGACT TCCACAGTTG
44801  ACCTTGGAAC CTCAGGGACT CCATCCCCCG TCCCCAGCCC CACAACTGCT
44851  GGCCCTCTCC TGGTGCCATT CACCCTCAAC TTCACCATCA CCAACCTGCA
44901  GTATGAGGAG GACATGCATC GCCCTGGTTC CAGGAGGTTC AACACCACGG
44951  AGAGGGTTCT GCAGGGTCTG CTCACGCCCT TGTTCAAGAA CACCAGTGTT
45001  GGCCCTCTGT ACTCTGGCTG CAGACTGACC TTGCTCAGAC TGAGAAGCA
45051  AGAGGCAGCC ACTGGAGTGG ACACCATCTG TACCCACCGC GTTGATCCCA
45101  TCGGACCTGG ACTGGACAGA GAGCGGCTAT ACTGGGAGCT GAGCCAGCTG
45151  ACCAACAGCA TCACAGAGCT GGGACCCTAC ACCCTGGATA GGGACAGTCT
45201  CTATGTCAAT GGCTTCAACC CTTGGAGCTC TGTGCCAACC ACCAGCACTC
45251  CTGGGACCTC CACAGTGCAC CTGGCAACCT CTGGGACTCC ATCCTCCCTG
45301  CCTGGCCACA CAGCCCCTGT CCCTCTCTTG ATACCATTCA CCCTCAACTT
45351  TACCATCACC GACCTGCATT ATGAAGAAAA CATGCAACAC CCTGGTTCCA
```

TABLE 30-continued

Human cDNA of CA125
(SEQ ID NO: 314)

```
45401  GGAAGTTCAA CACCACGGAG AGGGTTCTGC AGGGTCTGCT CAAGCCCTTG
45451  TTCAAGAGCA CCAGCGTTGG CCCTCTGTAC TCTGGCTGCA GACTGACCTT
45501  GCTCAGACCT GAGAAACATG GGGCAGCCAC TGGAGTGGAC GCCATCTGCA
45551  CCCTCCGCCT TGATCCCACT GGTCCTGGAC TGGACAGAGA GCGGCTATAC
45601  TGGGAGCTGA GCCAGCTGAC CAACAGCGTT ACAGAGCTGG GCCCCTACAC
45651  CCTGGACAGG GACAGTCTCT ATGTCAATGG CTTCACCCAT CGGAGCTCTG
45701  TGCCAACCAC CAGTATTCCT GGGACCTCTG CAGTGCACCT GGAAACCTCT
45751  GGGACTCCAG CCTCCCTCCC TGGCCACACA GCCCCTGGCC CTCTCCTGGT
45801  GCCATTCACC CTCAACTTCA CTATCACCAA CCTGCAGTAT GAGGAGGACA
45851  TGCGTCACCC TGGTTCCAGG AAGTTCAGCA CCACGGAGAG AGTCCTGCAG
45901  GGTCTGCTCA AGCCCTTGTT CAAGAACACC AGTGTCAGCT CTCTGTACTC
45951  TGGTTGCAGA CTGACCTTGC TCAGGCCTGA GAAGGATGGG GCAGCCACCA
46001  GAGTGGATGC TGTCTGCACC CATCGTCCTG ACCCCAAAAG CCCTGGACTG
46051  GACAGAGAGC GGCTGTACTG GAAGCTGAGC CAGCTGACCC ACGGCATCAC
46101  TGAGCTGGGC CCCTACACCC TGGACAGGCA CAGTCTCTAT GTCAATGGTT
46151  TCACCCATCA GAGCTCTATG ACGACCACCA GAACTCCTGA TACCTCCACA
46201  ATGCACCTGG CAACCTCGAG AACTCCAGCC TCCCTGTCTG GACCTACGAC
46251  CGCCAGCCCT CTCCTGGTGC TATTCACAAT TAACTTCACC ATCACTAACC
46301  TGCGGTATGA GGAGAACATG CATCACCCTG GCTCTAGAAA GTTTAACACC
46351  ACGGAGAGAG TCCTTCAGGG TCTGCTCAGG CCTGTGTTCA AGAACACCAG
46401  TGTTGGCCCT CTGTACTCTG GCTGCAGACT GACCACGCTC AGGCCCAAGA
46451  AGGATGGGGC AGCCACCAAA GTGGATGCCA TCTGCACCTA CCGCCCTGAT
46501  CCCAAAAGCC CTGGACTGGA CAGAGAGCAG CTATACTGGG AGCTGAGCCA
46551  GCTAACCCAC AGCATCACTG AGCTGGGCCC CTACACCCAG GACAGGGACA
46601  GTCTCTATGT CAATGGCTTC ACCCATCGGA GCTCTGTGCC AACCACCAGT
46651  ATTCCTGGGA CCTCTGCAGT GCACCTGGAA ACCTCTGGGA CTCCAGCCTC
46701  CCTCCCTGGC CACACAGCCC TGGCCCTCT CCTGGTGCCA TTCACCCTCA
46751  ACTTCACTAT CACCAACCTG CAGTATGAGG AGGACATGCG TCACCCTGGT
46801  TCCAGGAAGT TCAACACCAC GGAGAGAGTC CTGCAGGGTC TGCTCAAGCC
46851  CTTGTTCAAG AGCACCAGTG TTGGCCCTCT GTACTCTGGC TGCAGACTGA
46901  CCTTGCTCAG GCCTGAAAAA CGTGGGGCAG CCACCGGCGT GGACACCATC
46951  TGCACTCACC GCCTTGACCC TCTAAACCCA GGACTGGACA GAGAGCAGCT
47001  ATACTGGGAG CTGAGCAAAC TGACCCGTGG CATCATCGAG CTGGGCCCCT
47051  ACCTCCTGGA CAGAGGCAGT CTCTATGTCA ATGGTTTCAC CCATCGGACC
47101  TCTGTGCCCA CCACCAGCAC TCCTGGGACC TCCACAGTGG ACCTTGGAAC
47151  CTCAGGGACT CCATTCTCCC TCCCAAGCCC CGCANCNNCT GNCCCTCTCC
47201  TGNTNCCNTT CACCNTCAAC TTNACCATCA CCAACCTGCA NTANGNGGAN
47251  NACATGCNNC NCCCNGGNTC CAGGAAGTTC AACACCACNG AGAGGGTCCT
```

TABLE 30-continued

Human cDNA of CA125
(SEQ ID NO: 314)

```
47301  GCAGACTCTG CTTGGTCCTA TGTTCAAGAA CACCAGTGTT GGCCTTCTGT
47351  ACTCTGGCTG CAGACTGACC TTGCTCAGGT CCGAGAAGGA TGGAGCAGCC
47401  ACTGGAGTGG ATGCCATCTG CACCCACCGT CTTGACCCCA AAAGCCCTGG
47451  AGTGGACAGG GAGCAACTAT ACTGGGAGCT GAGCCAGCTG ACCAATGGCA
47501  TTAAAGAACT GGGCCCCTAC ACCCTGGACA GGAACAGTCT CTATGTCAAT
47551  GGGTTCACCC ATTGGATCCC TGTGCCCACC AGCAGCACTC CTGGGACCTC
47601  CACAGTGGAC CTTGGGTCAG GGACTCCATC CTCCCTCCCC AGCCCCACAA
47651  CTGCTGGCCC TCTCCTGGTG CCGTTCACCC TCAACTTCAC CATCACCAAC
47701  CTGAAGTACG AGGAGGACAT GCATTGCCCT GGCTCCAGGA AGTTCAACAC
47751  CACAGAGAGA GTCCTGCAGA GTCTGCTTGG TCCCATGTTC AAGAACACCA
47801  GTGTTGGCCC TCTGTACTCT GGCTGCAGAC TGACCTTGCT CAGGTCCGAG
47851  AAGGATGGAG CAGCCACTGG AGTGGATGCC ATCTGCACCC ACCGTCTTGA
47901  CCCCAAAAGC CCTGGAGTGG ACAGGGAGCA GCTATACTGG GAGCTGAGCC
47951  AGCTGACCAA TGGCATCAAA GAGCTGGGTC CCTACACCCT GGACAGAAAC
48001  AGTCTCTATG TCAATGGTTT CACCCATCAG ACCTCTGCGC CCAACACCAG
48051  CACTCCTGGG ACCTCCACAG TGGACCTTGG GACCTCAGGG ACTCCATCCT
48101  CCCTCCCCAG CCCTACANCN NCTGNCCCTC TCCTGNTNCC NTTCACCNTC
48151  AACTTNACCA TCACCAACCT GCANTANGNG GANNACATGC NNCNCCCNGG
48201  NTCCAGGAAG TTCAACACCA CNGAGNGNGT NCTGCAGGGT CTGCTNNNNC
48251  CCNTNTTCAA GAACNCCAGT GTNGGCCNTC TGTACTCTGG CTGCAGACTG
48301  ACCTNNCTCA GGNCNGAGAA GNATGGNGCA GCCACTGGAN TGGATGCCAT
48351  CTGCANCCAC CNNCNTNANC CCAAAAGNCC TGGACTGNAC AGNGAGCNGC
48401  TNTACTGGGA GCTNAGCCAN CTGACCAANN NCATCNNNGA GCTGGGNCCC
48451  TACACCCTGG ACAGGNACAG TCTCTATGTC AATGGTTTCA CCCATTGGAT
48501  CCCTGTGCCC ACCAGCAGCA CTCCTGGGAC CTCCACAGTG GACCTTGGGT
48551  CAGGGACTCC ATCCTCCCTC CCCAGCCCCA CAACTGCTGG CCCTCTCCTG
48601  GTGCCGTTCA CCCTCAACTT CACCATCACC AACCTGAAGT ACGAGGAGGA
48651  CATGCATTGC CCTGGCTCCA GGAAGTTCAA CACCACAGAG AGAGTCCTGC
48701  AGAGTCTGCT TGGTCCCATG TTCAAGAACA CCAGTGTTGG CCCTCTGTAC
48751  TCTGGCTGCA GACTGACCTC GCTCAGGTCC GAGAAGGATG GAGCAGCCAC
48801  TGGAGTGGAT GCCATCTGCA CCCACCGTGT TGACCCCAAA AGCCCTGGAG
48851  TGGACAGGGA GCAGCTATAC TGGGAGCTGA GCCAGCTGAC CAATGGCATC
48901  AAAGAGCTGG GTCCCTACAC CCTGGACAGA ACAGTCTCT ATGTCAATGG
48951  TTTCACCCAT CAGACCTCTG CGCCCAACAC CAGCACTCCT GGGACCTCCA
49001  CAGTGNACNT NGGNACCTCN GGGACTCCAT CCTCCNTCCC CNGCCNCACA
49051  TCTGCTGGCC CTCTCCTGGT GCCATTCACC CTCAACTTCA CCATCACCAA
49101  CCTGCAGTAC GAGGAGGACA TGCATCACCC AGGCTCCAGG AAGTTCAACA
49151  CCACGGAGCG GGTCCTGCAG GTCTGCTTG GTCCCATGTT CAAGAACACC
49201  AGTGTCGGCC TTCTGTACTC TGGCTGCAGA CTGACCTTGC TCAGGCCTGA
```

TABLE 30-continued

Human cDNA of CA125
(SEQ ID NO: 314)

```
49251   GAAGAATGGG GCAACCACTG GAATGGATGC CATCTGCACC CACCGTCTTG

49301   ACCCCAAAAG CCCTGGACTG NACAGNGAGC NGCTNTACTG GGAGCTNAGC

49351   CANCTGACCA ANNNCATCNN NGAGCTGGGN CCCTACACCC TGGACAGGNA

49401   CAGTCTCTAT GTCAATGGTT TCACCCATCN GANCTCTGNG CCCACCACCA

49451   GCACTCCTGG GACCTCCACA GTGNACNTNG GNACCTCNGG GACTCCATCC

49501   TCCNTCCCCN GCCNCACANC NNCTGNCCCT CTCCTGNTNC CNTTCACCNT

49551   CAACTTNACC ATCACCAACC TGCANTANGN GGANNACATG CNNCNCCCNG

49601   GNTCCAGGAA GTTCAACACC ACNGAGAGGG TTCTGCAGGG TCTGCTCAAA

49651   CCCTTGTTCA GGAATAGCAG TCTGGAATAC CTCTATTCAG GCTGCAGACT

49701   AGCCTCACTC AGGCCAGAGA AGGATAGCTC AGCCATGGCA GTGGATGCCA

49751   TCTGCACACA TCGCCCTGAC CCTGAAGACC TCGGACTGGA CAGAGAGCGA

49801   CTGTACTGGG AGCTGAGCAA TCTGACAAAT GGCATCCAGG AGCTGGGCCC

49851   CTACACCCTG GACCGGAACA GTCTCTATGT CAATGGTTTC ACCCATCGAA

49901   GCTCTATGCC CACCACCAGC ACTCCTGGGA CCTCCACAGT GGATGTGGGA

49951   ACCTCAGGGA CTCCATCCTC CAGCCCCAGC CCCACGACTG CTGGCCCTCT

50001   CCTGATACCA TTCACCCTCA ACTTCACCAT CACCAACCTG CAGTATGGGG

50051   AGGACATGGG TCACCCTGGC TCCAGGAAGT TCAACACCAC AGAGAGGGTC

50101   CTGCAGGGTC TGCTTGGTCC CATATTCAAG AACACCAGTG TTGGCCCTCT

50151   GTACTCTGGC TGCAGACTGA CCTCTCTCAG GTCTGAGAAG GATGGAGCAG

50201   CCACTGGAGT GGATGCCATC TGCATCCATC ATCTTGACCC CAAAAGCCCT

50251   GGACTCAACA GAGAGCGGCT GTACTGGGAG CTGAGCCAAC TGACCAATGG

50301   CATCAAAGAG CTGGGCCCCT ACACCCTGGA CAGGAACAGT CTCTATGTCA

50351   ATGGTTTCAC CCATCGGACC TCTGTGCCCA CCACCAGCAC TCCTGGGACC

50401   TCCACAGTGG ACCTTGGAAC CTCAGGGACT CCATTCTCCC TCCCAAGCCC

50451   CGCAACTGCT GGCCCTCTCC TGGTGCTGTT CACCCTCAAC TTCACCATCA

50501   CCAACCTGAA GTATGAGGAG GACATGCATC GCCCTGGCTC CAGGAAGTTC

50551   AACACCAGTG AGAGGGTCCT GCAGACTCTG CTTGGTCCTA TGTTCAAGAA

50601   CACCAGTGTT GGCCTTCTGT ACTCTGGCTG CAGACTGACC TTGCTCAGGT

50651   CCGAGAAGGA TGGAGCAGCC ACTGGAGTGG ATGCCATCTG CACCCACCGT

50701   CTTGACCCCA AAAGCCCTGG ACTGNACAGN GAGCNGCTNT ACTGGGAGCT

50751   NAGCCANCTG ACCAANNNCA TCNNNGAGCT GGGNCCCTAC ACCCTGGACA

50801   GGNACAGTCT CTATGTCAAT GGTTTCACCC ATCNGANCTC TGNGCCCACC

50851   ACCAGCACTC CTGGGACCTC CACAGTGNAC NTNGGNACCT CNGGGACTCC

50901   ATCCTCCNTC CCCNGCCNCA CANCNNCTGN CCCTCTCCTG NTNCCNTTCA

50951   CCNTCAACTT NACCATCACC AACCTGCANT ANGNGGANNA CATGCNNCNC

51001   CCNGGNTCCA GGAAGTTCAA CACCACNGAG AGAGTCCTTC AGGGTCTGCT

51051   CAGGCCTGTG TTCAAGAACA CCAGTGTTGG CCCTCTGTAC TCTGGCTGCA

51101   GACTGACCTT GCTCAGGCCC AAGAAGGATG GGGCAGCCAC CAAAGTGGAT
```

TABLE 30-continued

Human cDNA of CA125
(SEQ ID NO: 314)

```
51151  GCCATCTGCA CCTACCGCCC TGATCCCAAA AGCCCTGGAC TGGACAGAGA
51201  GCAGCTATAC TGGGAGCTGA GCCAGCTAAC CCACAGCATC ACTGAGCTGG
51251  GCCCCTACAC CCAGGACAGG GACAGTCTCT ATGTCAATGG CTTCACCCAT
51301  CGGAGCTCTG TGCCAACCAC CAGTATTCCT GGGACCTCTG CAGTGCACCT
51351  GGAAACCACT GGGACTCCAT CCTCCTTCCC CGGCCACACA GAGCCTGGCC
51401  CTCTCCTGAT ACCATTCACT TTCAACTTTA CCATCACCAA CCTGCGTTAT
51451  GAGGAAAACA TGCAACACCC TGGTTCCAGG AAGTTCAACA CCACGGAGAG
51501  GGTTCTGCAG GGTCTGCTCA CGCCCTTGTT CAAGAACACC AGTGTTGGCC
51551  CTCTGTACTC TGGCTGCAGA CTGACCTTGC TCAGACCTGA GAAGCAGGAG
51601  GCAGCCACTG GAGTGGACAC CATCTGTACC CACCGCGTTG ATCCCATCGG
51651  ACCTGGACTG GACAGAGAGC GGCTATACTG GGAGCTGAGC CAGCTGACCA
51701  ACAGCATCAC AGAGCTGGGA CCCTACACCC TGGATAGGGA CAGTCTCTAT
51751  GTCGATGGCT TCAACCCTTG GAGCTCTGTG CCAACCACCA GCACTCCTGG
51801  GACCTCCACA GTGCACCTGG CAACCTCTGG GACTCCATCC CCCCTGCCTG
51851  GCCACACAGC CCCTGTCCCT CTCTTGATAC CATTCACCCT CAACTTTACC
51901  ATCACCGACC TGCATTATGA AGAAAACATG CAACACCCTG GTTCCAGGAA
51951  GTTCAACACC ACGGAGAGGG TTCTGCAGGG TCTGCTCAAG CCCTTGTTCA
52001  AGAGCACCAG CGTTGGCCCT CTGTACTCTG GCTGCAGACT GACCTTGCTC
52051  AGACCTGAGA AACATGGGGC AGCCACTGGA GTGGACGCCA TCTGCACCCT
52101  CCGCCTTGAT CCCACTGGTC CTGGACTGGA CAGAGAGCGG CTATACTGGG
52151  AGCTGAGCCA GCTGACCAAC AGCATCACAG AGCTGGGACC CTACACCCTG
52201  GATAGGGACA GTCTCTATGT CAATGGCTTC AACCCTTGGA GCTCTGTGCC
52251  AACCACCAGC ACTCCTGGGA CCTCCACAGT GCACCTGGCA ACCTCTGGGA
52301  CTCCATCCTC CCTGCCTGGC ACACAACTG CTGGCCCTCT CCTGGTGCCG
52351  TTCACCCTCA ACTTCACCAT CACCAACCTG AAGTACGAGG AGGACATGCA
52401  TTGCCCTGGC TCCAGGAAGT TCAACACCAC AGAGAGAGTC CTGCAGAGTC
52451  TGCATGGTCC CATGTTCAAG AACACCAGTG TTGGCCCTCT GTACTCTGGC
52501  TGCAGACTGA CCTTGCTCAG GTCCGAGAAG GATGGAGCAG CCACTGGAGT
52551  GGATGCCATC TGCACCCACC GTCTTGACCC CAAAAGCCCT GGACTGNACA
52601  GNGAGCNGCT NTACTGGGAG CTNAGCCANC TGACCAANNN CATCNNNGAG
52651  CTGGGNCCCT ACACCCTGGA CAGGNACAGT CTCTATGTCA ATGGTTTCAC
52701  CCATCNGANC TCTGNGCCCA CCACCAGCAC TCCTGGGACC TCCACAGTGN
52751  ACNTNGGNAC CTCNGGGACT CCATCCTCCN TCCCCNGCCN CACANCNNCT
52801  GNCCCTCTCC TGNTNCCNTT CACCNTCAAC TTNACCATCA CCAACCTGCA
52851  NTANGNGGAN NACATGCNNC NCCCNGGNTC CAGGAAGTTC AACACCACNG
52901  AGNGNGTNCT GCAGGGTCTG CTNNNNCCCN TNTTCAAGAA CNCCAGTGTN
52951  GGCCNTCTGT ACTCTGGCTG CAGACTGACC TNNCTCAGGN CNGAGAAGNA
53001  TGGNGCAGCC ACTGGANTGG ATGCCATCTG CANCCACCNN CNTNANCCCA
53051  AAAGNCCTGG ACTGNACAGN GAGCNGCTNT ACTGGGAGCT NAGCCANCTG
```

TABLE 30-continued

Human cDNA of CA125
(SEQ ID NO: 314)

```
53101  ACCAACAGCA TCACAGAGCT GGGACCCTAC ACCCTGGATA GGGACAGTCT
53151  CTATGTCAAT GGTTTCACCC ATCGAAGCTC TATGCCCACC ACCAGTATTC
53201  CTGGGACCTC TGCAGTGCAC CTGGAAACCT CTGGGACTCC AGCCTCCCTC
53251  CCTGGCCACA CAGCCCCTGG CCCTCTCCTG GTGCCATTCA CCCTCAACTT
53301  CACTATCACC AACCTGCAGT ATGAGGAGGA CATGCGTCAC CCTGGTTCCA
53351  GGAAGTTCAA CACCACGGAG AGAGTCCTGC AGGGTCTGCT CAAGCCCTTG
53401  TTCAAGAGCA CCAGTGTTGG CCCTCTGTAC TCTGGCTGCA GACTGACCTT
53451  GCTCAGGCCT GAAAAACGTG GGGCAGCCAC CGGCGTGGAC ACCATCTGCA
53501  CTCACCGCCT TGACCCTCTA AACCCTGGAC TGNACAGNGA GCNGCTNTAC
53551  TGGGAGCTNA GCCANCTGAC CAANNNCATC NNNGAGCTGG GNCCCTACAC
53601  CCTGGACAGG NACAGTCTCT ATGTCAATGG TTTCACCCAT CNGANCTCTG
53651  NGCCCACCAC CAGCACTCCT GGGACCTCCA CAGTGNACNT NGGNACCTCN
53701  GGGACTCCAT CCTCCNTCCC CNGCCNCACA NCNNCTGNCC CTCTCCTGNT
53751  NCCNTTCACC NTCAACTTNA CCATCACCAA CCTGCANTAN GNGGANNACA
53801  TGCNNCNCCC NGGNTCCAGG AAGTTCAACA CCACNGAGNG NGTNCTGCAG
53851  GGTCTGCTNN NNCCCNTNTT CAAGAACNCC AGTGTNGGCC NTCTGTACTC
53901  TGGCTGCAGA CTGACCTNNC TCAGGNCNGA GAAGNATGGN GCAGCCACTG
53951  GANTGGATGC CATCTGCANC CACCNNCNTN ANCCCAAAAG NCCTGGACTG
54001  NACAGNGAGC NGCTNTACTG GGAGCTNAGC CANCTGACCA ANNNCATCNN
54051  NGAGCTGGGN CCCTACACCC TGGACAGGNA CAGTCTCTAT GTCAATGGTT
54101  TTCACCCTCG GAGCTCTGTG CCAACCACCA GCACTCCTGG GACCTCCACA
54151  GTGCACCTGG CAACCTCTGG GACTCCATCC TCCCTGCCTG GCCACACAGC
54201  CCCTGTCCCT CTCTTGATAC CATTCACCCT CAACTTTACC ATCACCAACC
54251  TGCATTATGA AGAAAACATG CAACACCCTG GTTCCAGGAA GTTCAACACC
54301  ACGGAGCGGG TCCTGCAGGG TCTGCTTGGT CCCATGTTCA AGAACACAAG
54351  TGTCGGCCTT CTGTACTCTG GCTGCAGACT GACCTTGCTC AGGCCTGAGA
54401  AGAATGGGGC AGCCACTGGA ATGGATGCCA TCTGCAGCCA CCGTCTTGAC
54451  CCCAAAAGCC CTGGACTGNA CAGNGAGCNG CTNTACTGGG AGCTNAGCCA
54501  NCTGACCAAN NNCATCNNNG AGCTGGGNCC CTACACCCTG GACAGGNACA
54551  GTCTCTATGT CAATGGTTTC ACCCATCNGA NCTCTGNGCC CACCACCAGC
54601  ACTCCTGGGA CCTCCACAGT GNACNTNGGN ACCTCNGGGA CTCCATCCTC
54651  CNTCCCCNGC CNCACANCNN CTGNCCCTCT CCTGNTNCCN TTCACCNTCA
54701  ACTTNACCAT CACCAACCTG CANTANGNGG ANNACATGCN NCNCCCNGGN
54751  TCCAGGAAGT TCAACACCAC NGAGNGNGTN CTGCAGGGTC TGCTNNNNCC
54801  CNTNTTCAAG AACNCCAGTG TNGGCCNTCT GTACTCTGGC TGCAGACTGA
54851  CCTNNCTCAG GNCNGAGAAG NATGGNGCAG CCACTGGANT GGATGCCATC
54901  TGCANCCACC NNCNTNANCC CAAAAGNCCT GGACTGNACA GNGAGCNGCT
54951  NTACTGGGAG CTNAGCCANC TGACCAANNN CATCNNNGAG CTGGGNCCCT
```

TABLE 30-continued

Human cDNA of CA125
(SEQ ID NO: 314)

```
55001  ACACCCTGGA CAGGNACAGT CTCTATGTCA ATGGTTTCAC CCATCAGAAC
55051  TCTGTGCCCA CCACCAGTAC TCCTGGGACC TCCACAGTGT ACTGGGCAAC
55101  CACTGGGACT CCATCCTCCT TCCCCGGCCA CACAGAGCCT GGCCCTCTCC
55151  TGATACCATT CACTTTCAAC TTTACCATCA CCAACCTGCA TTATGAGGAA
55201  AACATGCAAC ACCCTGGTTC CAGGAAGTTC AACACCACGG AGAGGGTTCT
55251  GCAGGGTCTG CTCACGCCCT TGTTCAAGAA CACCAGTGTT GGCCCTCTGT
55301  ACTCTGGCTG CAGACTGACC TTGCTCAGAC CTGAGAAGCA GGAGGCAGCC
55351  ACTGGAGTGG ACACCATCTG TACCCACCGC GTTGATCCCA TCGGACCTGG
55401  ACTGNACAGN GAGCNGCTNT ACTGGGAGCT NAGCCANCTG ACCAANNNCA
55451  TCNNNGAGCT GGGNCCCTAC ACCCTGGACA GGNACAGTCT CTATGTCAAT
55501  GGTTTCACCC ATCNGANCTC TGNGCCCACC ACCAGCACTC CTGGGACCTC
55551  CACAGTGNAC NTNGGNACCT CNGGGACTCC ATCCTCCNTC CCCNGCCNCA
55601  CANCNNCTGN CCCTCTCCTG NTNCCNTTCA CCNTCAACTT NACCATCACC
55651  AACCTGCANT ANGNGGANNA CATGCNNCNC CCNGGNTCCA GGAAGTTCAA
55701  CACCACNGAG NGNGTNCTGC AGGGTCTGCT NNNNCCCNTN TTCAAGAACN
55751  CCAGTGTNGG CCNTCTGTAC TCTGGCTGCA GACTGACCTN NCTCAGGNCN
55801  GAGAAGNATG GNGCAGCCAC TGGANTGGAT GCCATCTGCA NCCACCNNCN
55851  TNANCCCAAA AGNCCTGGAC TGNACAGNGA GCNGCTNTAC TGGGAGCTNA
55901  GCCANCTGAC CAANNNCATC NNNGAGCTGG GNCCCTACAC CCTGGACAGG
55951  NACAGTCTCT ATGTCAATGG TTTCACCCAT CGGAGCTCTG TGCCAACCAC
56001  CAGCAGTCCT GGGACCTCCA CAGTGCACCT GGCAACCTCT GGGACTCCAT
56051  CCTCCCTGCC TGGCCACACA GCCCCTGTCC CTCTCTTGAT ACCATTCACC
56101  CTCAACTTTA CCATCACCAA CCTGCATTAT GAAGAAAACA TGCAACACCC
56151  TGGTTCCAGG AAGTTCAACA CCACGGAGAG GGTTCTGCAG GGTCTGCTCA
56201  AGCCCTTGTT CAAGAGCACC AGTGTTGGCC CTCTGTACTC TGGCTGCAGA
56251  CTGACCTTGC TCAGACCTGA GAAACATGGG GCAGCCACTG GAGTGGACGC
56301  CATCTGCACC CTCCGCCTTG ATCCCACTGG TCCTGGACTG NACAGNGAGC
56351  NGCTNTACTG GGAGCTNAGC CANCTGACCA ANNNCATCNN NGAGCTGGGN
56401  CCCTACACCC TGGACAGGNA CAGTCTCTAT GTCAATGGTT TCACCCATCN
56451  GANCTCTGNG CCCACCACCA GCACTCCTGG GACCTCCACA GTGNACNTNG
56501  GNACCTCNGG GACTCCATCC TCCNTCCCCN GCCNCACANC NNCTGNCCCT
56551  CTCCTGNTNC CNTTCACCNT CAACTTNACC ATCACCAACC TGCANTANGN
56601  GGANNACATG CNNCNCCCNG GNTCCAGGAA GTTCAACACC ACNGAGNGNG
56651  TNCTGCAGGG TCTGCTNNNN CCCNTNTTCA AGAACNCCAG TGTNGGCCNT
56701  CTGTACTCTG GCTGCAGACT GACCTNNCTC AGGNCNGAGA AGNATGGNGC
56751  AGCCACTGGA NTGGATGCCA TCTGCANCCA CCNNCNTNAN CCCAAAAGNC
56801  CTGGACTGNA CAGNGAGCNG CTNTACTGGG AGCTNAGCCA NCTGACCAAN
56851  NNCATCNNNG AGCTGGGNCC CTACACCCTG GACAGGNACA GTCTCTATGT
56901  CAATGGTTTC ACCCATCGGA CCTCTGTGCC CACCACCAGC ACTCCTGGGA
```

TABLE 30-continued

Human cDNA of CA125
(SEQ ID NO: 314)

```
56951  CCTCCACAGT GCACCTGGCA ACCTCTGGGA CTCCATCCTC CCTGCCTGGC
57001  CACACAGCCC CTGTCCCTCT CTTGATACCA TTCACCCTCA ACTTTACCAT
57051  CACCAACCTG CAGTATGAGG AGGACATGCA TCGCCCTGGA TCTAGGAAGT
57101  TCAACACCAC AGAGAGGGTC CTGCAGGGTC TGCTTAGTCC CATTTTCAAG
57151  AACTCCAGTG TTGGCCCTCT GTACTCTGGC TGCAGACTGA CCTCTCTCAG
57201  GCCCGAGAAG GATGGGGCAG CAACTGGAAT GGATGCTGTC TGCCTCTACC
57251  ACCCTAATCC CAAAAGACCT GGGCTGGACA GAGAGCAGCT GTACTGCGAG
57301  CTAAGCCAGC TGACCCACAA CATCACTGAG CTGGGCCCCT ACAGCCTGGA
57351  CAGGGACAGT CTCTATGTCA ATGGTTTCAC CCATCAGAAC TCTGTGCCCA
57401  CCACCAGTAC TCCTGGGACC TCCACAGTGT ACTGGGCAAC CACTGGGACT
57451  CCATCCTCCT TCCCCGGCCA CACANCNNCT GNCCCTCTCC TGNTNCCNTT
57501  CACCNTCAAC TTNACCATCA CCAACCTGCA NTANGNGGAN NACATGCNNC
57551  NCCCNGGNTC CAGGAAGTTC AACACCACNG AGNGNGTNCT GCAGGGTCTG
57601  CTNNNNCCCN TNTTCAAGAA CNCCAGTGTN GGCCNTCTGT ACTCTGGCTG
57651  CAGACTGACC TNNCTCAGGN CNGAGAAGNA TGGNGCAGCC ACTGGANTGG
57701  ATGCCATCTG CANCCACCNN CNTNANCCCA AAAGNCCTGG ACTGNACAGN
57751  GAGCNGCTNT ACTGGGAGCT NAGCCANCTG ACCAANNNCA TCNNNGAGCT
57801  GGGNCCCTAC ACCCTGGACA GGNACAGTCT CTATGTCAAT GGTTTCACCC
57851  ATTGGAGCTC TGGGCTCACC ACCAGCACTC CTTGGACTTC CACAGTTGAC
57901  CTTGGAACCT CAGGGACTCC ATCCCCCGTC CCCAGCCCCA CAACTGCTGG
57951  CCCTCTCCTG GTGCCATTCA CCCTAAACTT CACCATCACC AACCTGCAGT
58001  ATGAGGAGGA CATGCATCGC CCTGGATCTA GGAAGTTCAA CGCCACAGAG
58051  AGGGTCCTGC AGGGTCTGCT TAGTCCCATA TTCAAGAACA CCAGTGTTGG
58101  CCCTCTGTAC TCTGGCTGCA GACTGACCTT GCTCAGACCT GAGAAGCAGG
58151  AGGCAGCCAC TGGAGTGGAC ACCATCTGTA CCCACCGCGT TGATCCCATC
58201  GGACCTGGAC TGNACAGNGA GCNGCTNTAC TGGGAGCTNA GCCANCTGAC
58251  CAANNNCATC NNNGAGCTGG GNCCCTACAC CCTGGACAGG NACAGTCTCT
58301  ATGTCAATGG TTTCACCCAT CNGANCTCTG NGCCCACCAC CAGCACTCCT
58351  GGGACCTCCA CAGTGNACNT NGGNACCTCN GGGACTCCAT CCTCCNTCCC
58401  CNGCCNCACA NCNNCTGNCC CTCTCCTGNT NCCNTTCACC NTCAACTTNA
58451  CCATCACCAA CCTGCANTAN GNGGANNACA TGCNNCNCCC NGGNTCCAGG
58501  AAGTTCAACA CCACNGAGNG NGTNCTGCAG GGTCTGCTNN NNCCCNTNTT
58551  CAAGAACNCC AGTGTNGGCC NTCTGTACTC TGGCTGCAGA CTGACCTNNC
58601  TCAGGNCNGA GAAGNATGGN GCAGCCACTG GANTGGATGC CATCTGCANC
58651  CACCNNCNTN ANCCCAAAAG NCCTGGACTG NACAGNGAGC NGCTNTACTG
58701  GGAGCTNAGC CANCTGACCA ANNNCATCNN NGAGCTGGGN CCCTACACCC
58751  TGGACAGGNA CAGTCTCTAT GTCAATGGTT TCACCCATCG GAGCTTTGGG
58801  CTCACCACCA GCACTCCTTG GACTTCCACA GTTGACCTTG GAACCTCAGG
```

TABLE 30-continued

Human cDNA of CA125
(SEQ ID NO: 314)

```
58851  GACTCCATCC CCCGTCCCCA GCCCCACAAC TGCTGGCCCT CTCCTGGTGC

58901  CATTCACCCT AAACTTCACC ATCACCAACC TGCAGTATGA GGAGGACATG

58951  CATCGCCCTG GCTCCAGGAA GTTCAACACC ACGGAGAGGG TCCTTCAGGG

59001  TCTGCTTACG CCCTTGTTCA GGAACACCAG TGTCAGCTCT CTGTACTCTG

59051  GTTGCAGACT GACCTTGCTC AGGCCTGAGA AGGATGGGGC AGCCACCAGA

59101  GTGGATGCTG TCTGCACCCA TCGTCCTGAC CCCAAAAGCC CTGGACTGNA

59151  CAGNGAGCNG CTNTACTGGG AGCTNAGCCA NCTGACCAAN NNCATCNNNG

59201  AGCTGGGNCC CTACACCCTG GACAGGNACA GTCTCTATGT CAATGGTTTC

59251  ACCCATCNGA NCTCTGNGCC CACCACCAGC ACTCCTGGGA CCTCCACAGT

59301  GNACNTGGGN ACCTCNGGGA CTCCATCCTC CNTCCCCNGC CNCACANCNN

59351  CTGNCCCTCT CCTGNTNCCN TTCACCNTCA ACTTNACCAT CACCAACCTG

59401  CANTANGNGG ANNACATGCN NCNCCCNGGN TCCAGGAAGT TCAACACCAC

59451  NGAGNGNGTN CTGCAGGGTC TGCTNNNNCC CNTNTTCAAG AACNCCAGTG

59501  TNGGCCNTCT GTACTCTGGC TGCAGACTGA CCTNNCTCAG GNCNGAGAAG

59551  NATGGNGCAG CCACTGGANT GGATGCCATC TGCANCCACC NNCNTNANCC

59601  CAAAAGNCCT GGACTGNACA GNGAGCNGCT NTACTGGGAG CTNAGCCANC

59651  TGACCAANNN CATCNNNGAG CTGGGNCCCT ACACCCTGGA CAGGNACAGT

59701  CTCTATGTCA ATGGTTTCAC CCATTGGATC CTGTGCCCA CCAGCAGCAC

59751  TCCTGGGACC TCCACAGTGG ACCTTGGGTC AGGGACTCCA TCCTCCCTCC

59801  CCAGCCCCAC AACTGCTGGC CCTCTCCTGG TACCATTCAC CCTCAACTTC

59851  ACCATCACCA ACCTGCAGTA TGGGGAGGAC ATGGGTCACC CTGGCTCCAG

59901  GAAGTTCAAC ACCACAGAGA GGGTCCTGCA GGGTCTGCTT GGTCCCATAT

59951  TCAAGAACAC CAGTGTTGGC CCTCTGTACT CTGGCTGCAG ACTGACCTCT

60001  CTCAGGTCCG AGAAGGATGG AGCAGCCACT GGAGTGGATG CCATCTGCAT

60051  CCATCATCTT GACCCCAAAA GCCCTGGACT GNACAGNGAG CNGCTNTACT

60101  GGGAGCTNAG CCANCTGACC AANNNCATCN NNGAGCTGGG NCCCTACACC

60151  CTGGACAGGN ACAGTCTCTA TGTCAATGGT TTCACCCATC NGANCTCTGN

60201  GCCCACCACC AGCACTCCTG GGACCTCCAC AGTGNACNTN GGNACCTCNG

60251  GGACTCCATC CTCCNTCCCC NGCCNCACAN CNNCTGNCCC TCTCCTGNTN

60301  CCNTTCACCN TCAACTTNAC CATCACCAAC CTGCANTANG NGGANNACAT

60351  GCNNCNCCCN GGNTCCAGGA AGTTCAACAC CACNGAGNGN GTNCTGCAGG

60401  GTCTGCTNNN NCCCNTNTTC AAGAACNCCA GTGTNGGCCN TCTGTACTCT

60451  GGCTGCAGAC TGACCTNNCT CAGGNCNGAG AAGNATGGNG CAGCCACTGG

60501  ANTGGATGCC ATCTGCANCC ACCNNCNTNA NCCCAAAAGN CCTGGACTGN

60551  ACAGNGAGCN GCTNTACTGG GAGCTNAGCC ANCTGACCAA NNNCATCNNN

60601  GAGCTGGGNC CCTACACCCT GGACAGGNAC AGTCTCTATG TCAATGGTTT

60651  CACCCATCAG ACCTTTGCGC CAACACCAG CACTCCTGGG ACCTCCACAG

60701  TGGACCTTGG GACCTCAGGG ACTCCATCCT CCCTCCCCAG CCCTACATCT

60751  GCTGGCCCTC TCCTGGTGCC ATTCACCCTC AACTTCACCA TCACCAACCT
```

TABLE 30-continued

Human cDNA of CA125
(SEQ ID NO: 314)

```
60801  GCAGTACGAG GAGGACATGC ATCACCCAGG CTCCAGGAAG TTCAACACCA
60851  CGGAGCGGGT CCTGCAGGGT CTGCTTGGTC CCATGTTCAA GAACACCAGT
60901  GTCGGCCTTC TGTACTCTGG CTGCAGACTG ACCTTGCTCA GGCCTGAGAA
60951  GAATGGGGCA GCCACCAGAG TGGATGCTGT CTGCACCCAT CGTCCTGACC
61001  CCAAAAGCCC TGGACTGNAC AGNGAGCNGC TNTACTGGGA GCTNAGCCAN
61051  CTGACCAANN NCATCNNNGA GCTGGGNCCC TACACCCTGG ACAGGNACAG
61101  TCTCTATGTC AATGGTTTCA CCCATCNGAN CTCTGNGCCC ACCACCAGCA
61151  CTCCTGGGAC CTCCACAGTG NACNTNGGNA CCTCNGGGAC TCCATCCTCC
61201  NTCCCCNGCC NCACAGCCCC TGTCCCTCTC TTGATACCAT TCACCCTCAA
61251  CTTTACCATC ACCAACCTGC ATTATGAAGA AACATGCAA CACCCTGGTT
61301  CCAGGAAGTT CAACACCACG GAGAGGGTTC TGCAGGGTCT GCTCAAGCCC
61351  TTGTTCAAGA GCACCAGCGT TGGCCCTCTG TACTCTGGCT GCAGACTGAC
61401  CTTGCTCAGA CCTGAGAAAC ATGGGGCAGC CACTGGAGTG GACGCCATCT
61451  GCACCCTCCG CCTTGATCCC ACTGGTCCTG GACTGGACAG AGAGCGGCTA
61501  TACTGGGAGC TGAGCCAGCT GACCAACAGC GTTACAGAGC TGGGCCCCTA
61551  CACCCTGGAC AGGGACAGTC TCTATGTCAA TGGCTTCACC CAGCGGAGCT
61601  CTGTGCCAAC CACCAGTATT CCTGGGACCT CTGCAGTGCA CCTGGAAACC
61651  TCTGGGACTC CAGCCTCCCT CCCTGGCCAC ACAGCCCCTG GCCCTCTCCT
61701  GGTGCCATTC ACCCTCAACT TCACTATCAC CAACCTGCAG TATGAGGTGG
61751  ACATGCGTCA CCCTGGTTCC AGGAAGTTCA ACACCACGGA GAGAGTCCTG
61801  CAGGGTCTGC TCAAGCCCTT GTTCAAGAGC ACCAGTGTTG GCCCTCTGTA
61851  CTCTGGCTGC AGACTGACCT TGCTCAGGCC TGAAAAACGT GGGGCAGCCA
61901  CCGGCGTGGA CACCATCTGC ACTCACCGCC TTGACCCTCT AAACCCTGGA
61951  CTGGACAGAG AGCAGCTATA CTGGGAGCTG AGCAAACTGA CCCGTGGCAT
62001  CATCGAGCTG GGCCCCTACC TCCTGGACAG AGGCAGTCTC TATGTCAATG
62051  GTTTCACCCA TCGGAACTTT GTGCCCATCA CCAGCACTCC TGGGACCTCC
62101  ACAGTACACC TAGGAACCTC TGAAACTCCA TCCTCCCTAC CTAGACCCAT
62151  AGTGCCTGGC CCTCTCCTGG TGCCATTCAC CCTCAACTTC ACCATCACCA
62201  ACTTGCAGTA TGAGGAGGCC ATGCGACACC CTGGCTCCAG GAAGTTCAAT
62251  ACCACGGAGA GGGTCCTACA GGGTCTGCTC AGGCCCTTGT TCAAGAATAC
62301  CAGTATCGGC CCTCTGTACT CCAGCTGCAG ACTGACCTTG CTCAGGCCAG
62351  AGAAGGACAA GGCAGCCACC AGAGTGGATG CCATCTGTAC CCACCACCCT
62401  GACCCTCAAA GCCCTGGACT GAACAGAGAG CAGCTGTACT GGGAGCTGAG
62451  CCAGCTGACC CACGGCATCA CTGAGCTGGG CCCCTACACC CTGGACAGGG
62501  ACAGTCTCTA TGTCGATGGT TTCACTCATT GGAGCCCCAT ACCGACCACC
62551  AGCACTCCTG GGACCTCCAT AGTGAACCTG GAACCTCTG GGATCCCACC
62601  TTCCCTCCCT GAAACTACAN CNNCTGNCCC TCTCCTGNTN CCNTTCACCN
62651  TCAACTTNAC CATCACCAAC CTGCANTANG NGGANNACAT GCNNCNCCCN
```

TABLE 30-continued

Human cDNA of CA125
(SEQ ID NO: 314)

```
62701  GGNTCCAGGA AGTTCAACAC CACNGAGAGG GTTCTGCAGG GTCTGCTCAA
62751  GCCCTTGTTC AAGAGCACCA GTGTTGGCCC TCTGTATTCT GGCTGCAGAC
62801  TGACCTTGCT CAGGCCTGAG AAGGACGGAG TAGCCACCAG AGTGGACGCC
62851  ATCTGCACCC ACCGCCCTGA CCCCAAAATC CCTGGGCTAG ACAGACAGCA
62901  GCTATACTGG GAGCTGAGCC AGCTGACCCA CAGCATCACT GAGCTGGGAC
62951  CCTACACCCT GGATAGGGAC AGTCTCTATG TCAATGGTTT CACCCAGCGG
63001  AGCTCTGTGC CCACCACCAG CACTCCTGGG ACTTTCACAG TACAGCCGGA
63051  AACCTCTGAG ACTCCATCAT CCCTCCCTGG CCCCACAGCC ACTGGCCCTG
63101  TCCTGCTGCC ATTCACCCTC AATTTTACCA TCACTAACCT GCAGTATGAG
63151  GAGGACATGC ATCGCCCTGG CTCCAGGAAG TTCAACACCA CGGAGAGGGT
63201  CCTTCAGGGT CTGCTTATGC CCTTGTTCAA GAACACCAGT GTCAGCTCTC
63251  TGTACTCTGG TTGCAGACTG ACCTTGCTCA GGCCTGAGAA GGATGGGGCA
63301  GCCACCAGAG TGGATGCTGT CTGCACCCAT CGTCCTGACC CCAAAAGCCC
63351  TGGACTGGAC AGAGAGCGGC TGTACTGGAA GCTGAGCCAG CTGACCCACG
63401  GCATCACTGA GCTGGGCCCC TACACCCTGG ACAGGCACAG TCTCTATGTC
63451  AATGGTTTCA CCCATCAGAG CTCTATGACG ACCACCAGAA CTCCTGATAC
63501  CTCCACAATG CACCTGGCAA CCTCGAGAAC TCCAGCCTCC CTGTCTGGAC
63551  CTACGACCGC CAGCCCTCTC CTGGTGCTAT TCACAATTAA CTTCACCATC
63601  ACTAACCTGC GGTATGAGGA GAACATGCAT CACCCTGGCT CTAGAAAGTT
63651  TAACACCACG GAGAGAGTCC TTCAGGGTCT GCTCAGGCCT GTGTTCAAGA
63701  ACACCAGTGT TGGCCCTCTG TACTCTGGCT GCAGACTGAC CTTGCTCAGG
63751  CCCAAGAAGG ATGGGGCAGC CACCAAAGTG GATGCCATCT GCACCTACCG
63801  CCCTGATCCC AAAAGCCCTG GACTGGACAG AGAGCAGCTA TACTGGGAGC
63851  TGAGCCAGCT AACCCACAGC ATCACTGAGC TGGGCCCCTA CACCCTGGAC
63901  AGGGACAGTC TCTATGTCAA TGGTTTCACA CAGCGGAGCT CTGTGCCCAC
63951  CACTAGCATT CCTGGGACCC CCACAGTGGA CCTGGGAACA TCTGGGACTC
64001  CAGTTTCTAA ACCTGGTCCC TCGGCTGCCA GCCCTCTCCT GGTGCTATTC
64051  ACTCTCAACT TCACCATCAC CAACCTGCGG TATGAGGAGA ACATGCAGCA
64101  CCCTGGCTCC AGGAAGTTCA ACACCACGGA GAGGGTCCTT CAGGGCCTGC
64151  TCAGGTCCCT GTTCAAGAGC ACCAGTGTTG GCCCTCTGTA CTCTGGCTGC
64201  AGACTGACTT TGCTCAGGCC TGAAAAGGAT GGGACAGCCA CTGGAGTGGA
64251  TGCCATCTGC ACCCACCACC CTGACCCCAA AGCCCTAGG CTGGACAGAG
64301  AGCAGCTGTA TTGGGAGCTG AGCCAGCTGA CCCACAATAT CACTGAGCTG
64351  GGCCACTATG CCCTGGACAA CGACAGCCTC TTTGTCAATG GTTTCACTCA
64401  TCGGAGCTCT GTGTCCACCA CCAGCACTCC TGGGACCCCC ACAGTGTATC
64451  TGGGAGCATC TAAGACTCCA GCCTCGATAT TTGGCCCTTC AGCTGCCAGC
64501  CATCTCCTGA TACTATTCAC CTCAACTTC ACCATCACTA ACCTGCGGTA
64551  TGAGGAGAAC ATGTGGCCTG GCTCCAGGAA GTTCAACACT ACAGAGAGGG
64601  TCCTTCAGGG CCTGCTAAGG CCCTTGTTCA AGAACACCAG TGTTGGCCCT
```

TABLE 30-continued

Human cDNA of CA125
(SEQ ID NO: 314)

```
64651  CTGTACTCTG GCTCCAGGCT GACCTTGCTC AGGCCAGAGA AAGATGGGGA
64701  AGCCACCGGA GTGGATGCCA TCTGCACCCA CCGCCCTGAC CCCACAGGCC
64751  CTGGGCTGGA CAGAGAGCAG CTGTATTTGG AGCTGAGCCA GCTGACCCAC
64801  AGCATCACTG AGCTGGGCCC CTACACACTG GACAGGGACA GTCTCTATGT
64851  CAATGGTTTC ACCCATCGGA GCTCTGTACC CACCACCAGC ACCGGGGTGG
64901  TCAGCGAGGA GCCATTCACA CTGAACTTCA CCATCAACAA CCTGCGCTAC
64951  ATGGCGGACA TGGGCCAACC CGGCTCCCTC AAGTTCAACA TCACAGACAA
65001  CGTCATGAAG CACCTGCTCA GTCCTTTGTT CCAGAGGAGC AGCCTGGGTG
65051  CACGGTACAC AGGCTGCAGG GTCATCGCAC TAAGGTCTGT GAAGAACGGT
65101  GCTGAGACAC GGGTGGACCT CCTCTGCACC TACCTGCAGC CCCTCAGCGG
65151  CCCAGGTCTG CCTATCAAGC AGGTGTTCCA TGAGCTGAGC CAGCAGACCC
65201  ATGGCATCAC CCGGCTGGGC CCCTACTCTC TGGACAGGGA CAGCCTCTAC
65251  CTTAACGGTT ACAATGAACC TGGTCTAGAT GAGCCTCCTA CAACTCCCAA
65301  GCCAGCCACC ACATTCCTGC CTCCTCTGTC AGAAGCCACA ACAGCCATGG
65351  GGTACCACCT GAAGACCCTC ACACTCAACT TCACCATCTC CAATCTCCAG
65401  TATTCACCAG ATATGGGCAA GGGCTCAGCT ACATTCAACT CCACCGAGGG
65451  GGTCCTTCAG CACCTGCTCA GACCCTTGTT CCAGAAGAGC AGCATGGGCC
65501  CCTTCTACTT GGGTTGCCAA CTGATCTCCC TCAGGCCTGA GAAGGATGGG
65551  GCAGCCACTG GTGTGGACAC CACCTGCACC TACCACCCTG ACCCTGTGGG
65601  CCCCGGGCTG GACATACAGC AGCTTTACTG GAGCTGAGT CAGCTGACCC
65651  ATGGTGTCAC CCAACTGGGC TTCTATGTCC TGGACAGGGA TAGCCTCTTC
65701  ATCAATGGCT ATGCACCCCA GAATTTATCA ATCCGGGGCG AGTACCAGAT
65751  AAATTTCCAC ATTGTCAACT GGAACCTCAG TAATCCAGAC CCCACATCCT
65801  CAGAGTACAT CACCCTGCTG AGGGACATCC AGGACAAGGT CACCACACTC
65851  TACAAAGGCA GTCAACTACA TGACACATTC CGCTTCTGCC TGGTCACCAA
65901  CTTGACGATG GACTCCGTGT TGGTCACTGT CAAGGCATTG TTCTCCTCCA
65951  ATTTGGACCC CAGCCTGGTG GAGCAAGTCT TTCTAGATAA GACCCTGAAT
66001  GCCTCATTCC ATTGGCTGGG CTCCACCTAC CAGTTGGTGG ACATCCATGT
66051  GACAGAAATG GAGTCATCAG TTTATCAACC AACAAGCAGC TCCAGCACCC
66101  AGCACTTCTA CCTGAATTTC ACCATCACCA ACCTACCATA TTCCCAGGAC
66151  AAAGCCCAGC CAGGCACCAC CAATTACCAG AGGAACAAAA GGAATATTGA
66201  GGATGCGCTC AACCAACTCT TCCGAAACAG CAGCATCAAG AGTTATTTTT
66251  CTGACTGTCA AGTTTCAACA TTCAGGTCTG TCCCCAACAG GCACCACACC
66301  GGGGTGGACT CCCTGTGTAA CTTCTCGCCA CTGGCTCGGA GAGTAGACAG
66351  AGTTGCCATC TATGAGGAAT TTCTGCGGAT GACCCGGAAT GGTACCCAGC
66401  TGCAGAACTT CACCCTGGAC AGGAGCAGTG TCCTTGTGGA TGGGTATTCT
66451  CCCAACAGAA ATGAGCCCTT AACTGGGAAT TCTGACCTTC CCTTCTGGGC
66501  TGTCATCCTC ATCGGCTTGG CAGGACTCCT GGGACTCATC ACATGCCTGA
```

TABLE 30-continued

Human cDNA of CA125
(SEQ ID NO: 314)

| | |
|---|---|
| 66551 | TCTGCGGTGT CCTGGTGACC ACCCGCCGGC GGAAGAAGGA AGGAGAATAC |
| 66601 | AACGTCCAGC AACAGTGCCC AGGCTACTAC CAGTCACACC TAGACCTGGA |
| 66651 | GGATCTGCAA TGACTGGAAC TTGCCGGTGC CTGGGGTGCC TTTCCCCCAG |
| 66701 | CCAGGGTCCA AGAAGCTTG GCTGGGGCAG AAATAAACCA TATTGGTCGG |
| 66751 | AAAAAAAAAA AAAAA |

TABLE 31

Human Protein of CA125 Molecule
(SEQ ID NO: 315)

| | |
|---|---|
| 1 | MLKPSGLPGS SSPTRSLMTG SRSTKATPEM DSGLTGATLS PKTSTGAIVV |
| 51 | TEHTLPFTSP DKTLASPTSS VVGRTTQSLG VMSSALPEST SRGMTHSEQR |
| 101 | TSPSLSPQVN GTPSRNYPAT SMVSGLSSPR TRTSSTEGNF TKEASTYTLT |
| 151 | VETTSGPVTE KYTVPTETST TEGDSTETPW DTRYIPVKIT SPMKTFADST |
| 201 | ASKENAPVSM TPAETTVTDS HTPGRTNPSF GTLYSSFLDL SPKGTPNSRG |
| 251 | ETSLELILST TGYPFSSPEP GSAGHSRIST SAPLSSSASV LDNKISETSI |
| 301 | FSGQSLTSPL SPGVPEARAS TMPNSAIPFS MTLSNAETSA ERVRSTISSL |
| 351 | GTPSISTKQT AETILTFHAF AETMDIPSTH IAKTLASEWL GSPGTLGGTS |
| 401 | TSALTTTSPS TTLVSEETNT HHSTSGKETE GTLNTSMTPL ETSAPGEESE |
| 451 | MTATLVPTLG FTTLDSKIRS PSQVSSSHPT RELRTTGSTS GRQSSSTAAH |
| 501 | GSSDILRATT SSTSKASSWT SESTAQQFSE PQHTQWVETS PSMKTERPPA |
| 551 | STSVAAPITT SVPSVVSGFT TLKTSSTKGI WLEETSADTL IGESTAGPTT |
| 601 | HQFAVPTGIS MTGGSSTRGS QGTTHLLTRA TASSETSADL TLATNGVPVS |
| 651 | VSPAVSKTAA GSSPPGGTKP SYTMVSSVIP ETSSLQSSAF REGTSLGLTP |
| 701 | LNTRHPFSSP EPDSAGHTKI STSIPLLSSA SVLEDKVSAT STFSHHKATS |
| 751 | SITTGTPEIS TKTKPSSAVL SSMTLSNAAT SPERVRNATS PLTHPSPSGE |
| 801 | ETAGSVLTLS TSAETTDSPN IHPTGTLTSE SSESPSTLSL PSVSGVKTTF |
| 851 | SSSTPSTHLF TSGEETEETS NPSVSQPETS VSRVRTTLAS TSVPTPVFPT |
| 901 | MDTWPTRSAQ FSSSHLVSEL RATSSTSVTN STGSALPKIS HLTGTATMSQ |
| 951 | TNRDTFNDSA APQSTTWPET SPRFKTGLPS ATTTVSTSAT SLSATVMVSK |
| 1001 | FTSPATSSME ATSIREPSTT ILTTETTNGP GSMAVASTNI PIGKGYITEG |
| 1051 | RLDTSHLPIG TTASSETSMD FTMAKESVSM SVSPSQSMDA AGSSTPGRTS |
| 1101 | QFVDTFSDDV YHLTSREITI PRDGTSSALT PQMTATHPPS PDPGSARSTW |
| 1151 | LGILSSSPSS PTPKVTMSST FSTQRVTTSM IMDTVETSRW NMPNLPSTTS |
| 1201 | LTPSNIPTSG AIGKSTLVPL DTPSPATSLE ASEGGLPTLS TYPESTNTPS |
| 1251 | IHLGAHASSE SPSTINLTMA SVVKPGSYTP LTFPSIETHI HVSTARMAYS |
| 1301 | SGSSPEMTAP GETNTGSTWD PTTYITTTDP KDTSSAQVST PHSVRTLRTT |
| 1351 | ENHPKTESAT PAAYSGSPKI SSSPNLTSPA TKAWTITDTT EHSTQLHYTK |
| 1401 | LAEKSSGFET QSAPGPVSVV IPTSPTIGSS TLELTSDVPG EPLVLAPSEQ |
| 1451 | TTITLPMATW LSTSLTEEMA STDLDISSPS SPMSTFAIFP PMSTPSHELS |

TABLE 31-continued

Human Protein of CA125 Molecule
(SEQ ID NO: 315)

```
1501  KSEADTSAIR NTDSTTLDQH LGIRSLGRTG DLTTVPITPL TTTWTSVIEH

1551  STQAQDTLSA TMSPTHVTQS LKDQTSIPAS ASPSHLTEVY PELGTQGRSS

1601  SEATTFWKPS TDTLSREIET GPTNIQSTPP MDNTTTGSSS SGVTLGIAHL

1651  PIGTSSPAET STNMALERRS STATVSMAGT MGLLVTSAPG RSISQSLGRV

1701  SSVLSESTTE GVTDSSKGSS PRLNTQGNTA LSSSLEPSYA EGSQMSTSIP

1751  LTSSPTTPDV EFIGGSTFWT KEVTTVMTSD ISKSSARTES SSATLMSTAL

1801  GSTENTGKEK LRTASMDLPS PTPSMEVTPW ISLTLSNAPN TTDSLDLSHG

1851  VHTSSAGTLA TDRSLNTGVT RASRLENGSD TSSKSLSMGN STHTSMTDTE

1901  KSEVSSSIHP RPETSAPGAE TTLTSTPGNR AISLTLPFSS IPVEEVISTG

1951  ITSGPDINSA PMTHSPITPP TIVWTSTGTI EQSTQPLHAV SSEKVSVQTQ

2001  STPYVNSVAV SASPTHENSV SSGSSTSSPY SSASLESLDS TISRRNAITS

2051  WLWDLTTSLP TTTWPSTSLS EALSSGHSGV SNPSSTTTEF PLFSAASTSA

2101  AKQRNPETET HGPQNTAAST LNTDASSVTG LSETPVGASI SSEVPLPMAI

2151  TSRSDVSGLT SESTANPSLG TASSAGTKLT RTISLPTSES LVSFRMNKDP

2201  WTVSIPLGSH PTTNTETSIP VNSAGPPGLS TVASDVIDTP SDGAESIPTV

2251  SFSPSPDTEV TTISHFPEKT THSFRTISSL THELTSRVTP IPGDWMSSAM

2301  STKPTGASPS ITLGERRTIT SAAPTTSPIV LTASFTETST VSLDNETTVK

2351  TSDILDARKT NELPSDSSSS SDLINTSIAS STMDVTKTAS ISPTSISGMT

2401  ASSSPSLFSS DRPQVPTSTT ETNTATSPSV SSNTYSLDGG SNVGGTPSTL

2451  PPFTITHPVE TSSALLAWSR PVRTFSTMVS TDTASGENPT SSNSVVTSVP

2501  APGTWASVGS TTDLPAMGFL KTSPAGEAHS LLASTIEPAT AFTPHLSAAV

2551  VTGSSATSEA SLLTTSESKA IHSSPQTPTT PTSGANWETS ATPESLLVVT

2601  ETSDTTLTSK ILVTDTILFS TVSTPPSKFP STGTLSGASF PTLLPDTPAI

2651  PLTATEPTSS LATSFDSTPL VTIASDSLGT VPETTLTMSE TSNGDALVLK

2701  TVSNPDRSIP GITIQGVTES PLHPSSTSPS KIVAPRNTTY EGSITVALST

2751  LPAGTTGSLV FSQSSENSET TALVDSSAGL ERASVMPLTT GSQGMASSGG

2801  IRSGSTHSTG TKTFSSLPLT MNPGEVTAMS EITTNRLTAT QSTAPKGIPV

2851  KPTSAESGLL TPVSASSSPS KAFASLTTAP PSTWGIPQST LTFEFSEVPS

2901  LDTKSASLPT PGQSLNTIPD SDASTASSSL SKSPEKNPRA RMMTSTKAIS

2951  ASSFQSTGFT ETPEGSASPS MAGHEPRVPT SGTGDPRYAS ESMSYPDPSK

3001  ASSAMTSTSL ASKLTTLFST GQAARSGSSS SPISLSTEKE TSFLSPTAST

3051  SRKTSLFLGP SMARQPNILV HLQTSALTLS PTSTLNMSQE EPPELTSSQT

3101  IAEEEGTTAE TQTLTFTPSE TPTSLLPVSS PTEPTARRKS SPETWASSIS

3151  VPAKTSLVET TDGTLVTTIK MSSQAAQGNS TWPAPAEETG TSPAGTSPGS

3201  PEVSTTLKIM SSKEPSISPE IRSTVRNSPW KTPETTVPME TTVEPVTLQS

3251  TALGSGSTSI SHLPTGTTSP TKSPTENMLA TERVSLSPSP PEAWTNLYSG

3301  TPGGTRQSLA TMSSVSLESP TARSITGTGQ QSSPELVSKT TGMEFSMWHG

3351  STGGTTGDTH VSLSTSSNIL EDPVTSPNSV SSLTDKSKHK TETWVSTTAI
```

TABLE 31-continued

Human Protein of CA125 Molecule
(SEQ ID NO: 315)

```
3401  PSTVLNNKIM AAEQQTSRSV DEAYSSTSSW SDQTSGSDIT LGASPDVTNT

3451  LYITSTAQTT SLVSLPSGDQ GITSLTNPSG GKTSSASSVT SPSIGLETLR

3501  ANVSAVKSDI APTAGHLSQT SSPAEVSILD VTTAPTPGIS TTITTMGTNS

3551  ISTTTPNPEV GMSTMDSTPA TERRTTSTEH PSTWSSTAAS DSWTVTDMTS

3601  NLKVARSPGT ISTMHTTSFL ASSTELDSMS TPHGRITVIG TSLVTPSSDA

3651  SAVKTETSTS ERTLSPSDTT ASTPISTFSR VQRMSISVPD ILSTSWTPSS

3701  TEAEDVPVSM VPTDHASTKT DPNTPLSTFL FDSLSTLDWD TGRSLSSATA

3751  TTSAPQGATT PQELTLETMI SPATSQLPFS IGHITSAVTP AAMARSSGVT

3801  FSRPDPTSKK AEQTSTQLPT TTSAHPGQVP RSAATTLDVI PHTAKTPDAT

3851  FQRQGQTALT TEARATSDSW NEKEKSTPSA PWITEMMNSV SEDTIKEVTS

3901  SSSVLKDPEY AGHKLGIWDD FIPKFGKAAH MRELPLLSPP QDKEAIHPST

3951  NTVETTGWVT SSEHASHSTI PAHSASSKLT SPVVTTSTRE QAIVSMSTTT

4001  WPESTRARTE PNSFLTIELR DVSPYMDTSS TTQTSIISSP GSTAITKGHR

4051  TEITSYKRIS SSFLAQSMRS SDSPSEAITR LSNFPAMTES GGMILAMQTS

4101  PPGATSISAP TLDTSATASW TGTPLATTQR FTYSEKTTLF SKGREDTSQP

4151  SPPCVEETSS SSSVVPIHAT TSPSNILLTS QGHSPSSTPP VTSVFLSETS

4201  GLGKTTDMSR ISLEPGTSLP PNLSSTAGEA LSTYEASRDT KAIHHSADTA

4251  VTNMEATSSE YSPIPGHTKP SKATSPLVTS HIMGDITSST SVFGSSETTE

4301  IETVSSVNQG LQERSTSQVA SSATETSTVI THVSSGDATT HVTKTQATFS

4351  SGTSISSPHQ FITSTNTFTD VSTNPSTSLI MTESSGVTIT TQTGPTGAAT

4401  QGPYLLDTST MPYLTETPLA VTPDFMQSEK TTLISKGPKD VTWTSPPSVA

4451  ETSYPSSLTP FLVTTIPPAT STLQGQHTSS PVSATSVLTS GLVKTTDMLN

4501  TSMEPVTNSP QNLNNPSNEI LATLAATTDI ETIHPSINKA VTNMGTASSA

4551  HVLHSTLPVS SEPSTATSPM VPASSMGDAL ASISIPGSET TDIEGEPTSS

4601  LTAGRKENST LQEMNSTTES NIILSNVSVG AITEATKMEV PSFDATFIPT

4651  PAQSTKFPDI FSVASSRLSN SPPMTISTHM TTTQTGSSGA TSKIPLALDT

4701  STLETSAGTP SVVTEGFAHS KITTAMNNDV KDVSQTNPPF QDEASSPSSQ

4751  APVLVTTLPS SVAFTPQWHS TSSPVSMSSV LTSSLVKTAG KVDTSLETVT

4801  SSPQSMSNTL DDISVTSAAT TDIETTHPSI NTVVTNVGTT GSAFESHSTV

4851  SAYPEPSKVT SPNVTTSTME DTTISRSIPK SSKTTRTETE TTSSLTPKLR

4901  ETSISQEITS STETSTVPYK ELTGATTEVS RTDVTSSSST SFPGPDQSTV

4951  SLDISTETNT RLSTSPIMTE SAEITITTQT GPHGATSQDT FTMDPSNTTP

5001  QAGIHSAMTH GFSQLDVTTL MSRIPQDVSW TSPPSVDKTS SPSSFLSSPA

5051  MTTPSLISST LPEDKLSSPM TSLLTSGLVK ITDILRTRLE PVTSSLPNFS

5101  STSDKILATS KDSKDTKEIF PSINTEETNV KANNSGHESH SPALADSETP

5151  KATTQMVITT TVGDPAPSTS MPVHGSSETT NIKREPTYFL TPRLRETSTS

5201  QESSFPTDTS FLLSKVPTGT ITEVSSTGVI SSSKISTPDH DKSTVPPDTF

5251  TGEIPRVFTS SIKTKSAEMT ITTQASPPES ASHSTLPLDT STTLSQGGTH

5301  STVSQGFPYS EVTTLMGMGP GNVSWMTTPP VEETSSVSSL MSSPAMTSPS
```

TABLE 31-continued

Human Protein of CA125 Molecule
(SEQ ID NO: 315)

```
5351  PVSSTSPQSI PSSPLPVTAL PTSVLVTTTD VLGTTSPESV TSSPPNLSSI

5401  THERPATYKD TAHTEAAMHH STNTAVTNVG TSGSGHKSQS SVLADSETSK

5451  ATPLMSTAST LGDTSVSTST PNISQTNQIQ TEPTASLSPR LRESSTSEKT

5501  SSTTETNTAF SYVPTGAITQ ASRTEISSSR TSISDLDRST IAPDISTGMI

5551  TRLFTSPIMT KSAEMTVTTQ TTTPGATSQG ILPWDTSTTL FQGGTHSTVS

5601  QGFPHSEITT LRSRTPGDVS WMTTPPVEET SSGFSLMSPS MTSPSPVSST

5651  SPESIPSSPL PVTALLTSVL VTTTNVLGTT SPEPVTSSPP NLSSPTQERL

5701  TTYKDTAHTE AMHASMHTNT AVANVGTSIS GHESQSSVPA DSHTSKATSP

5751  MGITFAMGDT SVYTSTPAFF ETRIQSESTS SLIPGLRDTR TSEEINTVTE

5801  TSTVLSEVPT TTTTEVSRTE VITSSRTTIS GPDHSKMSPY ISTETITRLS

5851  TFPFVTGSTE MAITNQTGPI GTISQATLTL DTSSTASWEG THSPVTQRFP

5901  HSEETTTMSR STKGVSWQSP PSVEETSSPS SPVPLPAITS HSSLYSAVSG

5951  SSPTSALPVT SLLTSGRRKT IDMLDTHSEL VTSSLPSASS FSGEILTSEA

6001  STNTETIHFS ENTAETNMGT TNSMHKLHSS VSIHSQPSGH TPPKVTGSMM

6051  EDAIVSTSTP GSPETKNVDR DSTSPLTPEL KEDSTALVMN STTESNTVFS

6101  SVSLDAATEV SRAEVTYYDP TFMPASAQST KSPDISPEAS SSHSNSPPLT

6151  ISTHKTIATQ TGPSGVTSLG QLTLDTSTIA TSAGTPSART QDFVDSETTS

6201  VMNNDLNDVL KTSPFSAEEA NSLSSQAPLL VTTSPSPVTS TLQEHSTSSL

6251  VSVTSVPTPT LAKITDMDTN LEPVTRSPQN LRNTLATSEA TTDTHTMHPS

6301  INTAMANVGT TSSPNEFYFT VSPDSDPYKA TSAVVITSTS GDSIVSTSMP

6351  RSSAMKKIES ETTFSLIFRL RETSTSQKIG SSSDTSTVFD KAFTAATTEV

6401  SRTELTSSSR TSIQGTEKPT MSPDTSTRSV TMLSTFAGLT KSEERTIATQ

6451  TGPHRATSQG TLTWDTSITT SQAGTHSAMT HGFSQLDLST LTSRVPEYIS

6501  GTSPPSVEKT SSSSSLLSLP AITSPSPVPT TLPESRPSSP VHLTSLPTSG

6551  LVKTTDMLAS VASLPPNLGS TSHKIPTTSE DIKDTEKMYP STNIAVTNVG

6601  TTTSEKESYS SVPAYSEPPK VTSPMVTSFN IRDTIVSTSM PGSSEITRIE

6651  MESTFSLAHG LKGTSTSQDP IVSTEKSAVL HKLTTGATET SRTEVASSRR

6701  TSIPGPDHST ESPDISTEVI PSLPISLGIT ESSNMTIITR TGPPLGSTSQ

6751  GTFTLDTPTT SSRAGTHSMA TQEFPHSEMT TVMNKDPEIL SWTIPPSIEK

6801  TSFSSSLMPS PAMTSPPVSS TLPKTIHTTP SPMTSLLTPS LVMTTDTLGT

6851  SPEPTTSSPP NLSSTSHVIL TTDEDTTAIE AMHPSTSTAA TNVETTCSGH

6901  GSQSSVLTDS EKTKATAPMD TTSTMGHTTV STSMSVSSET TKIKRESTYS

6951  LTPGLRETSI SQNASFSTDT SIVLSEVPTG TTAEVSRTEV TSSGRTSIPG

7001  PSQSTVLPEI STRTMTRLFA SPTMTESAEM TIPTQTGPSG STSQDTLTLD

7051  TSTTKSQAKT HSTLTQRFPH SEMTTLMSRG PGDMSWQSSP SLENPSSLPS

7101  LLSLPATTSP PPISSTLPVT ISSSPLPVTS LLTSSPVTTT DMLHTSPELV

7151  TSSPPKLSHT SDERLTTGKD TTNTEAVHPS TNTAASNVEI PSFGHESPSS

7201  ALADSETSKA TSPMFITSTQ EDTTVAISTP HFLETSRIQK ESISSLSPKL
```

TABLE 31-continued

Human Protein of CA125 Molecule
(SEQ ID NO: 315)

```
7251  RETGSSVETS SAIETSAVLS EVSIGATTEI SRTEVTSSSR TSISGSAEST

7301  MLPEISTTRK IIKFPTSPIL AESSEMTIKT QTSPPGSTSE STFTLDTSTT

7351  PSLVITHSTM TQRLPHSEIT TLVSRGAGDV PRPSSLPVEE TSPPSSQLSL

7401  SAMISPSPVS STLPASSHSS SASVTSPLTP GQVKTTEVLD ASAEPETSSP

7451  PSLSSTSVEI LATSEVTTDT EKIHPFPNTA VTKVGTSSSG HESPSSVLPD

7501  SETTKATSAM GTISIMGDTS VSTLTPALSN TRKIQSEPAS SLTTRLRETS

7551  TSEETSLATE ANTVLSKVST GATTEVSRTE AISFSRTSMS GPEQSTMSQD

7601  ISIGTIPRIS ASSVLTESAK MTITTQTGPS ESTLESTLNL NTATTPSWVE

7651  THSIVIQGFP HPEMTTSMGR GPGGVSWPSP PFVKETSPPS SPLSLPAVTS

7701  PHPVSTTFLA HIPPSPLPVT SLLTSGPATT TDILGTSTEP GTSSSSSLST

7751  TSHERLTTYK DTAHTEAVHP STNTGGTNVA TTSSGYKSQS SVLADSSPMC

7801  TTSTMGDTSV LTSTPAFLET RRIQTELASS LTPGLRESSG SEGTSSGTKM

7851  STVLSKVPTG ATTEISKEDV TSIPGPAQST ISPDTSTRTV SWFSTSPVMT

7901  ESAEITMNTH TSPLGATTQG TSTLDTSSTT SLTMTHSTIS QGFSHSQMST

7951  LMRRGPEDVS WMSPPLLEKT RPSFSLMSSP ATTSPSPVSS TLPESISSSP

8001  LPVTSLLTSG LAKTTDMLHK SSEPVTNSPA NLSSTSVEIL ATSEVTTDTE

8051  KTHPSSNRTV TDVGTSSSGH ESTSFVLADS QTSKVTSPMV ITSTMEDTSV

8101  STSTPGFFET SRIQTEPTSS LTLGLRKTSS SEGTSLATEM STVLSGVPTG

8151  ATAEVSRTEV TSSSRTSISG FAQLTVSPET STETITRLPT SSIMTESAEM

8201  MIKTQTDPPG STPESTHTVD ISTTPNWVET HSTVTQRFSH SEMTTLVSRS

8251  PGDMLWPSQS SVEETSSASS LLLSLPATTSP SPVSSTLVED FPSASLPVTS

8301  LLTPGLVITT DRMGISREPG TSSTSNLSST SHERLTTLED TVDTEAMQPS

8351  THTAVTNVRT SISGHESQSS VLSDSETPKA TSSMGTTYTM GETSVSISTS

8401  DFFETSRVQI EPTSSLTSGL RETSSSERIS SATEGSTVLS EVPSGATTEV

8451  SRTEVISSRG TSMSGPDQFT ISPDISTEAI TRLSTSPIMT ESAESAITIE

8501  TGSPGATSEG TLTLDTSTTT FWSGTHSTAS PGFSHSEMTT LMSRTPGDVP

8551  WPSLPSVEEA SSVSSSLSSP AMTSTSFFSA LPESISSSPH PVTALLTLGP

8601  VKTTDMLRTS SEPETSSPPN LSSTSAEILA TSEVTKDREK IHPSSNTPVV

8651  NVGTVIYKHL SPSSVLADLV TTKPTSPMAT TSTLGNTSVS TSTPAFPETM

8701  MTQPTSSLTS GLREISTSQE TSSATERSAS LSGMPTGATT KVSRTEALSL

8751  GRTSTPGPAQ STISPEISTE TITRISTPLT TTGSAEMTIT PKTGHSGASS

8801  QGTFTLDTSS RASWPGTHSA ATHRSPHSGM TTPMSRGPED VSWPSRPSVE

8851  KTSPPSSLVS LSAVTSPSPL YSTPSESSHS SPLRVTSLFT PVMMKTTDML

8901  DTSLEPVTTS PPSMNITSDE SLATSKATME TEAIQLSENT AVTQMGTISA

8951  RQEFYSSYPG LPEPSKVTSP VVTSSTIKDI VSTTIPASSE ITRIEMESTS

9001  TLTPTPRETS TSQEIHSATK PSTVPYKALT SATIEDSMTQ VMSSSRGPSP

9051  DQSTMSQDIS TEVITRLSTS PIKAESTEMT ITTQTGSPGA TSRGTLTLDT

9101  STTFMSGTHS TASQGFSHSQ MTALMSRTPG DVPWLSHPSV EEASSASFSL

9151  SSPVMTSSSP VSSTLPDSIH SSSLPVTSLL TSGLVKTTEL LGTSSEPETS
```

TABLE 31-continued

Human Protein of CA125 Molecule
(SEQ ID NO: 315)

```
 9201  SPPNLSSTSA EILATTEVTT DTEKLEMTNV VTSGYTHESP SSVLADSVTT
 9251  KATSSMGITY PTGDTNVLTS TPAFSDTSRI QTKSKLSLTP GLMETSISEE
 9301  TSSATEKSTV LSSVPTGATT EVSRTEAISS SRTSIPGPAQ STMSSDTSME
 9351  TITRISTPLT RKESTDMAIT PKTGPSGATS QGTFTLDSSS TASWPGTHSA
 9401  TTQRFPQSVV TTPMSRGPED VSWPSPLSVE KNSPPSSLVS SSSVTSPSPL
 9451  YSTPSGSSHS SPVPVTSLFT SIMMKATDML DASLEPETTS APNMNITSDE
 9501  SLATSKATTE TEAIHVFENT AASHVETTSA TEELYSSSPG FSEPTKVISP
 9551  VVTSSSIRDN MVSTTMPGSS GITRIEIESM SSLTPGLRET RTSQDITSST
 9601  ETSTVLYKMS SGATPEVSRT EVMPSSRTSI PGPAQSTMSL DISDEVVTRL
 9651  STSPIMTESA EITITTQTGY SLATSQVTLP LGTSMTFLSG THSTMSQGLS
 9701  HSEMTNLMSR GPESLSWTSP RFVETTRSSS SLTSLPLTTS LSPVSSTLLD
 9751  SSPSSPLPVT SLILPGLVKT TEVLDTSSEP KTSSSPNLSS TSVEIPATSE
 9801  IMTDTEKIHP SSNTAVAKVR TSSSVHESHS SVLADSETTI TIPSMGITSA
 9851  VDDTTVFTSN PAFSETRRIP TEPTFSLTPG FRETSTSEET TSITETSAVL
 9901  YGVPTSATTE VSMTEIMSSN RTHIPDSDQS TMSPDIITEV ITRLSSSSMM
 9951  SESTQMTITT QKSSPGATAQ STLTLATTTA PLARTHSTVP PRFLHSEMTT
10001  LMSRSPENPS WKSSPFVEKT SSSSSLLSLP VTTSPSVSST LPQSIPSSSF
10051  SVTSLLTPGM VKTTDTSTEP GTSLSPNLSG TSVEILAASE VTTDTEKIHP
10101  SSSMAVTNVG TTSSGHELYS SVSIHSEPSK ATYPVGTPSS MAETSISTSM
10151  PANFETTGFE AEPFSHLTSG FRKTNMSLDT SSVTPTNTPS SPGSTHLLQS
10201  SKTDFTSSAK TSSPDWPPAS QYTEIPVDII TPFNASPSIT ESTGITSFPE
10251  SRFTMSVTES THHLSTDLLP SAETISTGTV MPSLSEAMTS FATTGVPRAI
10301  SGSGSPFSRT ESGPGDATLS TIAESLPSST PVPFSSSTFT TTDSSTIPAL
10351  HEITSSSATP YRVDTSLGTE SSTTEGRLVM VSTLDTSSQP GRTSSTPILD
10401  TRMTESVELG TVTSAYQVPS LSTRLTRTDG IMEHITKIPN EAAHRGTIRP
10451  VKGPQTSTSP ASPKGLHTGG TKRMETTTTA LKTTTTALKT TSRATLTTSV
10501  YTPTLGTLTP LNASRQMAST ILTEMMITTP YVFPDVPETT SSLATSLGAE
10551  TSTALPRTTP SVLNRESETT ASLVSRSGAE RSPVIQTLDV SSSEPDTTAS
10601  WVIHPAETIP TVSKTTPNFF HSELDTVSST ATSHGADVSS AIPTNISPSE
10651  LDALTPLVTI SGTDTSTTFP TLTKSPHETE TRTTWLTHPA ETSSTIPRTI
10701  PNFSHHESDA TPSIATSPGA ETSSAIPIMT VSPGAEDLVT SQVTSSGTDR
10751  NMTIPTLTLS PGEPKTIASL VTHPEAQTSS AIPTSTISPA VSRLVTSMVT
10801  SLAAKTSTTN RALTNSPGEP ATTVSLVTHP AQTSPTVPWT TSIFFHSKSD
10851  TTPSMTTSHG AESSSAVPTP TVSTEVPGVV TPLVTSSRAV ISTTIPILTL
10901  SPGEPETTPS MATSHGEEAS SAIPTPTVSP GVPGVVTSLV TSSRAVTSTT
10951  IPILTFSLGE PETTPSMATS HGTEAGSAVP TVLPEVPGMV TSLVASSRAV
11001  TSTTLPTLTL SPGEPETTPS MATSHGAEAS STVPTVSPEV PGVVTSLVTS
11051  SSGVNSTSIP TLILSPGELE TTPSMATSHG AEASSAVPTP TVSPGVSGVV
```

TABLE 31-continued

Human Protein of CA125 Molecule
(SEQ ID NO: 315)

```
11101  TPLVTSSRAV TSTTIPILTL SSSEPETTPS MATSHGVEAS SAVLTVSPEV

11151  PGMVTSLVTS SRAVTSTTIP TLTISSDEPE TTTSLVTHSE AKMISAIPTL

11201  AVSPTVQGLV TSLVTSSGSE TSAFSNLTVA SSQPETIDSW VAHPGTEASS

11251  VVPTLTVSTG EPFTNISLVT HPAESSSTLP RTTSRFSHSE LDTMPSTVTS

11301  PEAESSSAIS TTISPGIPGV LTSLVTSSGR DISATFPTVP ESPHESEATA

11351  SWVTHPAVTS TTVPRTTPNY SHSEPDTTPS IATSPGAEAT SDFPTITVSP

11401  DVPDMVTSQV TSSGTDTSIT IPTLTLSSGE PETTTSFITY SETHTSSAIP

11451  TLPVSPGASK MLTSLVISSG TDSTTTFPTL TETPYEPETT AIQLIHPAET

11501  NTMVPRTTPK FSHSKSDTTL PVAITSPGPE ASSAVSTTTI SPDMSDLVTS

11551  LVPSSGTDTS TTFPTLSETP YEPETTATWL THPAETSTTV SGTIPNFSHR

11601  GSDTAPSMVT SPGVDTRSGV PTTTIPPSIP GVVTSQVTSS ATDTSTAIPT

11651  LTPSPGEPET TASSATHPGT QTGFTVPIRT VPSSEPDTMA SWVTHPPQTS

11701  TPVSRTTSSF SHSSPDATPV MATSPRTEAS SAVLTTISPG APEMVTSQIT

11751  SSGAATSTTV PTLTHSPGMP ETTALLSTHP RTETSKTFPA STVFPQVSET

11801  TASLTIRPGA ETSTALPTQT TSSLFTLLVT GTSRVDLSPT ASPGVSAKTA

11851  PLSTHPGTET STMIPTSTLS LGLLETTGLL ATSSSAETST STLTLTVSPA

11901  VSGLSSASIT TDKPQTVTSW NTETSPSVTS VGPPEFSRTV TGTTMTLIPS

11951  EMPTPPKTSH GEGVSPTTIL RTTMVEATNL ATTGSSPTVA KTTTTFNTLA

12001  GSLFTPLTTP GMSTLASESV TSRTSYNHRS WISTTSSYNR RYWTPATSTP

12051  VTSTFSPGIS TSSIPSSTAA TVPFMVPFTL NFTITNLQYE EDMRHPGSRK

12101  FNATERELQG LLKPLFRNSS LEYLYSGCRL ASLRPEKDSS AMAVDAICTH

12151  RPDPEDLGLD RERLYWELSN LTNGIQELGP YTLDRNSLYV NGFTHRSSMP

12201  TTSTPGTSTV DVGTSGTPSS SPSPTAAGPL LMPFTLNFTI TNLQYEEDMR

12251  RTGSRKFNTM ESVLQGLLKP LFKNTSVGPL YSGCRLTLLR PEKDGAATGV

12301  DAICTHRLDP KSPGLNREQL YWELSKLTND IEELGPYTLD RNSLYVNGFT

12351  HQSSVSTTST PGTSTVDLRT SGTPSSLSSP TIMAAGPLLV PFTLNFTITN

12401  LQYGEDMGHP GSRKFNTTER VLQGLLGPIF KNTSVGPLYS GCRLTSLRSE

12451  KDGAATGVDA ICIHHLDPKS PGLNRERLYW ELSQLTNGIK ELGPYTLDRN

12501  SLYVNGFTHR TSVPTSSTPG TSTVDLGTSG TPFSLPSPAT AGPLLVLFTL

12551  NFTITNLKYE EDMHRPGSRK FNTTERVLQT LLGPMFKNTS VGLLYSGCRL

12601  TLLRSEKDGA ATGVDAICTH RLDPKSPGLD REQLYWELSQ LTNGIKELGP

12651  YTLDRNSLYV NGFTHWIPVP TSSTPGTSTV DLGSGTPSSL PSPTAAGPLL

12701  VPFTLNFTIT NLQYEEDMHH PGSRKFNTTE RVLQGLLGPM FKNTSVGLLY

12751  SGCRLTLLRS EKDGAATGMD AICTHRLDPK SPGVDREQLY WELSQLTNGI

12801  KELGPYTLDR NSLYVNGFTH QTSAPNTSTP GTSTVDLGTS GTPSSLPSPT

12851  SAGPLLVPFT LNFTITNLQY EEDMRHPGSR KFNTTERVLQ GLLKPLFKST

12901  SVGPLYSGCR LTLLRSEKDG AATGVDAICT HRLDPKSPGV DREQLYWELS

12951  QLTNGIKELG PYTLDRNSLY VNGFTHQTSA PNTSTPGTST VDLGTSGTPS

13001  SLPSPTSAGP LLVPFTLNFT ITNLQYEEDM HHPGSRKFNT TERVLQGLLG
```

TABLE 31-continued

Human Protein of CA125 Molecule
(SEQ ID NO: 315)

```
13051  PMFKNTSVGL LYSGCRLTLL RPEKNGAATG MDAICSHRLD PKSPGLNREQ

13101  LYWELSQLTH GIKELGPYTL DRNSLYVNGF THRSSVAPTS TPGTSTVDLG

13151  TSGTPSSLPS PTTAVPLLVP FTLNFTITNL QYGEDMRHPG SRKFNTTERV

13201  LQGLLGPLFK NSSVGPLYSG CRLISLRSEK DGAATGVDAI CTHHLNPQSP

13251  GLDREQLYWQ LSQMTNGIKE LGPYTLDRNS LYVNGFTHRS SGLTTSTPWT

13301  STVDLGTSGT PSPVPSPTTA GPLLVPFTLN FTITNLQYEE DMHRPGSRKF

13351  NATERVLQGL LSPIFKNSSV GPLYSGCRLT SLRPEKDGAA TGMDAVCLYH

13401  PNPKRPGLDR EQLYWELSQL THNITELGPY SLDRDSLYVN GFTHQNSVPT

13451  TSTPGTSTVY WATTGTPSSF PGHTEPGPLL IPFTFNFTIT NLHYEENMQH

13501  PGSRKFNTTE RVLQGLLKPL FKNTSVGPLY SGCRLTSLRP EKDGAATGMD

13551  AVCLYHPNPK RPGLDREQLY CELSQLTHNI TELGPYSLDR DSLYVNGFTH

13601  QNSVPTTSTP GTSTVYWATT GTPSSFPGHT EPGPLLIPFT FNFTITNLHY

13651  EENMQHPGSR KFNTTERVLQ GLLKPLFKNT SVGPLYSGCR LTLLRPEKHE

13701  AATGVDTICT HRVDPIGPGL DRERLYWELS QLTNSITELG PYTLDRDSLY

13751  VNGFNPRSSV PTTSTPGTST VHLATSGTPS SLPGHTAPVP LLIPFTLNFT

13801  ITNLHYEENM QHPGSRKFNT TERVLQGLLK PLFKNTSVGP LYSGCRLTLL

13851  RPEKHEAATG VDTICTHRVD PIGPGLDREX LYWELSXLTX XIXELGPYXL

13901  DRXSLYVNGF XXXXXXXXTS TPGTSXVXLX TSGTPXXXPX XTSAGPLLVP

13951  FTLNFTITNL QYEEDMHHPG SRKFNTTERV LQGLLGPMFK NTSVGLLYSG

14001  CRLTLLRPEK NGAATGMDAI CSHRLDPKSP GLDREQLYWE LSQLTHGIKE

14051  LGPYTLDRNS LYVNGFTHRS SVAPTSTPGT STVDLGTSGT PSSLPSPTTA

14101  VPLLVPFTLN FTITNLQYGE DMRHPGSRKF NTTERVLQGL LGPLFKNSSV

14151  GPLYSGCRLI SLRSEKDGAA TGVDAICTHH LNPQSPGLDR EQLYWQLSQM

14201  TNGIKELGPY TLDRNSLYVN GFTHRSSGLT TSTPWTSTVD LGTSGTPSPV

14251  PSPTTAGPLL VPFTLNFTIT NLQYEEDMHR PGSRKFNATE RVLQGLLSPI

14301  FKNSSVGPLY SGCRLTSLRP EKDGAATGMD AVCLYHPNPK RPGLDREQLY

14351  WELSQLTHNI TELGPYSLDR DSLYVNGFTH QSSMTTTRTP DTSTMHLATS

14401  RTPASLSGPT TASPLLVLFT INCTITNLQY EEDMRRTGSR KFNTMESVLQ

14451  GLLKPLFKNT SVGPLYSGCR LTLLRPKKDG AATGVDAICT HRLDPKSPGL

14501  NREQLYWELS KLTNDIEELG PYTLDRNSLY VNGFTHQSSV STTSTPGTST

14551  VDLRTSGTPS SLSSPTIMXX XPLLXPFTLN FTITNLXYEE XMXXPGSRKF

14601  NTTERVLQGL LRPLFKNTSV SSLYSGCRLT LLRPEKDGAA TRVDAACTYR

14651  PDPKSPGLDR EQLYWELSQL THSITELGPY TLDRVSLYVN GFNPRSSVPT

14701  TSTPGTSTVH LATSGTPSSL PGHTXXXPLL XPFTLNFTIT NLXYEEXMXX

14751  PGSRKFNTTE RVLQGLLKPL FRNSSLEYLY SGCRLASLRP EKDSSAMAVD

14801  AICTHRPDPE DLGLDRERLY WELSNLTNGI QELGPYTLDR NSLYVNGFTH

14851  RSSFLTTSTP WTSTVDLGTS GTPSPVPSPT TAGPLLVPFT LNFTITNLQY

14901  EEDMHRPGSR RFNTTERVLQ GLLTPLFKNT SVGPLYSGCR LTLLRPEKQE
```

TABLE 31-continued

Human Protein of CA125 Molecule
(SEQ ID NO: 315)

```
14951  AATGVDTICT HRVDPIGPGL DRERLYWELS QLTNSITELG PYTLDRDSLY

15001  VNGFNPWSSV PTTSTPGTST VHLATSGTPS SLPGHTAPVP LLIPFTLNFT

15051  ITDLHYEENM QHPGSRKFNT TERVLQGLLK PLFKSTSVGP LYSGCRLTLL

15101  RPEKHGAATG VDAICTLRLD PTGPGLDRER LYWELSQLTN SVTELGPYTL

15151  DRDSLYVNGF THRSSVPTTS IPGTSAVHLE TSGTPASLPG HTAPGPLLVP

15201  FTLNFTITNL QYEEDMRHPG SRKFSTTERV LQGLLKPLFK NTSVSSLYSG

15251  CRLTLLRPEK DGAATRVDAV CTHRPDPKSP GLDRERLYWK LSQLTHGITE

15301  LGPYTLDRHS LYVNGFTHQS SMTTTRTPDT STMHLATSRT PASLSGPTTA

15351  SPLLVLFTIN FTITNQRYEE NMHHPGSRKF NTTERVLQGL LRPVFKNTSV

15401  GPLYSGCRLT LLRPKKDGAA TKVDAICTYR PDPKSPGLDR EQLYWELSQL

15451  THSITELGPY TQDRDSLYVN GFTHRSSVPT TSIPGTSAVH LETSGTPASL

15501  PGHTAPGPLL VPFTLNFTIT NLQYEEDMRH PGSRKFNTTE RVLQGLLKPL

15551  FKSTSVGPLY SGCRLTLLRP EKRGAATGVD TICTHRLDPL NPGLDREQLY

15601  WELSKLTRGI IELGPYLLDR GSLYVNGFTH RTSVPTTSTP GTSTVDLGTS

15651  GTPFSLPSPA XXXPLLXPFT LNFTITNLXY EEXMXXPGSR KFNTTERVLQ

15701  TLLGPMFKNT SVGLLYSGCR LTLLRSEKDG AATGVDAICT HRLDPKSPGV

15751  DREQLYWELS QLTNGIKELG PYTLDRNSLY VNGFTHWIPV PTSSTPGTST

15801  VDLGSGTPSL PSSPTTAGPL LVPFTLNFTI TNLKYEEDMH CPGSRKFNTT

15851  ERVLQSLLGP MFKNTSVGPL YSGCRLTLLR SEKDGAATGV DAICTHRLDP

15901  KSPGVDREQL YWELSQLTNG IKELGPYTLD RNSLYVNGFT HQTSAPNTST

15951  PGTSTVDLGT SGTPSSLPSP TXXXPLLXPF TLNFTITNLX YEEXMXXPGS

16001  RKFNTTERVL QGLLXPXFKX TSVGXLYSGC RLTLLRXEKX XAATXVDXXC

16051  XXXXDPXXPG LDREXLYWEL SXLTXXIXEL GPYXLDRXSL YVNGFTHWIP

16101  VPTSSTPGTS TVDLGSGTPS SLPSPTTAGP LLVPFTLNFT ITNLKYEEDM

16151  HCPGSRKFNT TERVLQSLLG PMFKNTSVGP LYSGCRLTSL RSEKDGAATG

16201  VDAICTHRVD PKSPGVDREQ LYWELSQLTN GIKELGPYTL DRNSLYVNGF

16251  THQTSAPNTS TPGTSTVDLG TSGTPSSLPS PTSAGPLLVP FTLNFTITNL

16301  QYEEDMHHPG SRKFNTTERV LQGLLGPMFK NTSVGLLYSG CRLTLLRPEK

16351  NGAATGMDAI CTHRLDPKSP GLDREXLYWE LSXLTXXIXE LGPYXLDRXS

16401  LYVNGFXXXX XXXXTSTPGT SXVXLXTSGT PXXXPXXTXX XPLLXPFTLN

16451  FTITNLXYEE XMXXPGSRKF NTTERVLQGL LKPLFRNSSL EYLYSGCRLA

16501  SLRPEKDSSA MAVDAICTHR PDPEDLGLDR ERLYWELSNL TNGIQELGPY

16551  TLDRNSLYVN GFTHRSSMPT TSTPGTSTVD VGTSGTPSSS PSPTTAGPLL

16601  IPFTLNFTIT NLQYGEDMGH PGSRKFNTTE RVLQGLLGPI FKNTSVGPLY

16651  SGCRLTSLRS EKDGAATGVD AICIHHLDPK SPGLNRERLY WELSQLTNGI

16701  KELGPYTLDR NSLYVNGFTH RTSVPTTSTP GTSTVDLGTS GTPFSLPSPA

16751  TAGPLLVLFT LNFTITNLKY EEDMHRPGSR KFNTTERVLQ TLLGPMFKNT

16801  SVGLLYSGCR LTLLRSEKDG AATGVDAICT HRLDPKSPGL DREXLYWELS

16851  XLTXXIXELG PYXLDRXSLY VNGFXXXXXX XXTSTPGTSX VXLXTSGTPX
```

TABLE 31-continued

Human Protein of CA125 Molecule
(SEQ ID NO: 315)

```
16901  XXPXXTXXXP LLXPFTLNFT ITNLXYEEXM XXPGSRKFNT TERVLQGLLR

16951  PVFKNTSVGP LYSGCRLTLL RPKKDGAATK VDAICTYRPD PKSPGLDREQ

17001  LYWELSQLTH SITELGPYTQ DRDSLYVNGF THRSSVPTTS IPGTSAVHLE

17051  TTGTPSSFPG HTEPGPLLIP FTFNFTITNL RYEENMQHPG SRKFNTTERV

17101  LQGLLTPLFK NTSVGPLYSG CRLTLLRPEK QEAATGVDTI CTHRVDPIGP

17151  GLDRERLYWE LSQLTNSITE LGPYTLDRDS LYVDGFNPWS SVPTTSTPGT

17201  STVHLATSGT PSPLPGHTAP VPLLIPFTLN FTITDLHYEE NMQHPGSRKF

17251  NTTERVLQGL LKPLFKSTSV GPLYSGCRLT LLRPEKHGAA TGVDAICTLR

17301  LDPTGPGLDR ERLYWELSQL TNSITELGPY TLDRDSLYVN GFNPWSSVPT

17351  TSTPGTSTVH LATSGTPSSL PGHTTAGPLL VPFTLNFTIT NLKYEEDMHC

17401  PGSRKFNTTE RVLQSLHGPM FKNTSVGPLY SGCRLTLLRS EKDGAATGVD

17451  AICTHRLDPK SPGLDREXLY WELSXLTXXI XELGPYXLDR XSLYVNGFXX

17501  XXXXXXTSTP GTSXVXLXTS GTPXXXPXXT XXXPLLXPFT LNFTITNLXY

17551  EEXMXXPGSR KFNTTERVLQ GLLXPXFKXT SVGXLYSGCR LTLLRXEKXX

17601  AATXVDXXCX XXXDPXXPGL DREXLYWELS XLTNSITELG PYTLDRDSLY

17651  VNGFTHRSSM PTTSIPGTSA VHLETSGTPA SLPGHTAPGP LLVPFTLNFT

17701  ITNLQYEEDM RHPGSRKFNT TERVLQGLLK PLFKSTSVGP LYSGCRLTLL

17751  RPEKRGAATG VDTICTHRLD PLNPGLDREX LYWELSXLTX XIXELGPYXL

17801  DRXSLYVNGF XXXXXXXXTS TPGTSXVXLX TSGTPXXXPX XTXXXPLLXP

17851  FTLNFTITNL XYEEXMXXPG SRKFNTTERV LQGLLXPXFK XTSVGXLYSG

17901  CRLTLLRXEK XXAATXVDXX CXXXXDPXXP GLDREXLYWE LSXLTXXIXE

17951  LGPYXLDRXS LYVNGFHPRS VPTTSTPGT  STVHLATSGT PSSLPGHTAP

18001  VPLLIPFTLN FTITNLHYEE NMQHPGSRKF NTTERVLQGL LGPMFKNTSV

18051  GLLYSGCRLT LLRPEKNGAA TGMDAICSHR LDPKSPGLDR EXLYWELSXL

18101  TXXIXELGPY XLDRXSLYVN GFXXXXXXXX TSTPGTSXVX LXTSGTPXXX

18151  PXXTXXXPLL XPFTLNFTIT NLXYEEXMXX PGSRKFNTTE RVLQGLLXPX

18201  FKXTSVGXLY SGCRLTLLRX EKXXAATXVD XXCXXXXDPX XPGLDREXLY

18251  WELSXLTXXI XELGPYXLDR XSLYVNGFTH QNSVPTTSTP GTSTVYWATT

18301  GTPSSFPGHT EPGPLLIPFT FNFTITNLHY EENMQHPGSR KFNTTERVLQ

18351  GLLTPLFKNT SVGPLYSGCR LTLLRPEKQE AATGVDTICT HRVDPIGPGL

18401  DREXLYWELS XLTXXIXELG PYXLDRXSLY VNGFXXXXXX XXTSTPGTSX

18451  VXLXTSGTPX XXPXXTXXXP LLXPFTLNFT ITNLXYEEXM XXPGSRKFNT

18501  TERVLQGLLX PXFKXTSVGX LYSGCRLTLL RXEKXXAATX VDXXCXXXXD

18551  PXXPGLDREX LYWELSXLTX XIXELGPYXL DRXSLYVNGF THRSSVPTTS

18601  SPGTSTVHLA TSGTPSSLPG HTAPVPLLIP FTLNFTITNL HYEENMQHPG

18651  SRKFNTTERV LQGLLKPLFK STSVGPLYSG CRLTLLRPEK HGAATGVDAI

18701  CTLRLDPTGP GLDREXLYWE LSXLTXXIXE LGPYXLDRXS LYVNGFXXXX

18751  XXXXTSTPGT SXVXLXTSGT PXXXPXXTXX XPLLXPFTLN FTITNLXYEE
```

TABLE 31-continued

Human Protein of CA125 Molecule
(SEQ ID NO: 315)

```
18801  XMXXPGSRKF NTTERVLQGL LXPXFKXTSV GXLYSGCRLT LLRXEKXXAA

18851  TXVDXXCXXX XDPXXPGLDR EXLYWELSXL TXXIXELGPY XLDRXSLYVN

18901  GFTHRTSVPT TSTPGTSTVH LATSGTPSSL PGHTAPVPLL IPFTLNFTIT

18951  NLQYEEDMHR PGSRKFNTTE RVLQGLLSPI FKNSSVGPLY SGCRLTSLRP

19001  EKDGAATGMD AVCLYHPNPK RPGLDREQLY CELSQLTHNI TELGPYSLDR

19051  DSLYVNGFTH QNSVPTTSTP GTSTVYWATT GTPSSFPGHT XXXPLLXPFT

19101  LNFTITNLXY EEXMXXPGSR KFNTTERVLQ GLLXPXFKXT SVGXLYSGCR

19151  LTLLRXEKXX AATXVDXXCX XXXDPXXPGL DREXLYWELS XLTXXIXELG

19201  PYXLDRXSLY VNGFTHWSSG LTTSTPWTST VDLGTSGTPS PVPSPTTAGP

19251  LLVPFTLNFT ITNLQYEEDM HRPGSRKFNA TERVLQGLLS PIFKNTSVGP

19301  LYSGCRLTLL RPEKQEAATG VDTICTHRVD PIGPGLDREX LYWELSXLTX

19351  XIXELGPYXL DRXSLYVNGF XXXXXXXXTS TPGTSXVXLX TSGTPXXXPX

19401  XTXXXPLLXP FTLNFTITNL XYEEXMXXPG SRKFNTTERV LQGLLXPXFK

19451  XTSVGXLYSG CRLTLLRXEK XXAATXVDXX CXXXXDPXXP GLDREXLYWE

19501  LSXLTXXIXE LGPYXLDRXS LYVNGFTHRS FGLTTSTPWT STVDLGTSGT

19551  PSPVPSPTTA GPLLVPFTLN FTITNLQYEE DMHRPGSRKF NTTERVLQGL

19601  LTPLFRNTSV SSLYSGCRLT LLRPEKDGAA TRVDAVCTHR PDPKSPGLDR

19651  EXLYWELSXL TXXIXELGPY XLDRXSLYVN GFXXXXXXXX TSTPGTSXVX

19701  LXTSGTPXXX PXXTXXXPLL XPFTLNFTIT NLXYEEXMXX PGSRKFNTTE

19751  RVLQGLLXPX FKXTSVGXLY SGCRLTLLRX EKXXAATXVD XXCXXXXDPX

19801  XPGLDREXLY WELSXLTXXI XELGPYXLDR XSLYVNGFTH WIPVPTSSTP

19851  GTSTVDLGSG TPSSLPSPTT AGPLLVPFTL NFTITNLQYG EDMHPGSRK

19901  FNTTERVLQG LLGPIFKNTS VGPLYSGCRL TSLRSEKDGA ATGVDAICIH

19951  HLDPKSPGLD REXLYWELSX LTXXIXELGP YXLDRXSLYV NGFXXXXXXX

20001  XTSTPGTSXV XLXTSGTPXX XPXXTXXXPL LXPFTLNFTI TNLXYEEXMX

20051  XPGSRKFNTT ERVLQGLLXP XFKXTSVGXL YSGCRLTLLR XEKXXAATXV

20101  DXXCXXXXDP XXPGLDREXL YWELSXLTXX IXELGPYXLD RXSLYVNGFT

20151  HQTFAPNTST PGTSTVDLGT SGTPSSLPSP TSAGPLLVPF TLNFTITNLQ

20201  YEEDMHHPGS RKFNTTERVL QGLLGPMFKN TSVGLLYSGC RLTLLRPEKN

20251  GAATRVDAVC THRPDPKSPG LDREXLYWEL SXLTXXIXEL GPYXLDRXSL

20301  YVNGFXXXXX XXXTSTPGTS XVXLXTSGTP XXXPXXTAPV PLLIPFTLNF

20351  TITNLHYEEN MQHPGSRKFN TTERVLQGLL RPLFKSTSVG PLYSGCRLTL

20401  LRPEKHGAAT GVDAICTLRL DPTGPGLDRE RLYWELSQLT NSVTELGPYT

20451  LDRDSLYVNG FTQRSSVPTT SIPGTSAVHL ETSGTPASLP GHTAPGPLLV

20501  PFTLNFTITN LQYEVDMRHP GSRKFNTTER VLQGLLKPLF KSTSVGPLYS

20551  GCRLTLLRPE KRGAATGVDT ICTHRLDPLN PGLDREQLYW ELSKLTRGII

20601  ELGPYLLDRG SLYVNGFTHR NFVPITSTPG TSTVHLGTSE TPSSLPRPIV

20651  PGPLLVPFTL NFTITNLQYE EAMRHPGSRK FNTTERVLQG LLRPLFKNTS

20701  IGPLYSSCRL TLLRPEKDKA ATRVDAICTH HPDPQSPGLN REQLYWELSQ
```

TABLE 31-continued

Human Protein of CA125 Molecule
(SEQ ID NO: 315)

```
20751  LTHGITELGP  YTLDRDSLYV  DGFTHWSPIP  TTSTPGTSIV  NLGTSGIPPS
20801  LPETTXXXPL  LXPFTLNFTI  TNLXYEEXMX  XPGSRKFNTT  ERVLQGLLKP
20851  LFKSTSVGPL  YSGCRLTLLR  PEKDGVATRV  DAICTHRPDP  KIPGLDRQQL
20901  YWELSQLTHS  ITELGPYTLD  RDSLYVNGFT  QRSSVPTTST  PGTFTVQPET
20951  SETPSSLPGP  TATGPVLLPF  TLNFTITNLQ  YEEDMHRPGS  RKFNTTERVL
21001  QGLLMPLFKN  TSVSSLYSGC  RLTLLRPEKD  GAATRVDAVC  THRPDPKSPG
21051  LDRERLYWKL  SQLTHGITEL  GPYTLDRHSL  YVNGFTHQSS  MTTTRTPDTS
21101  TMHLATSRTP  ASLSGPTTAS  PLLVLFTINF  TITNLRYEEN  MHHPGSRKFN
21151  TTERVLQGLL  RPVFKNTSVG  PLYSGCRLTL  LRPKKDGAAT  KVDAICTYRP
21201  DPKSPGLDRE  QLYWELSQLT  HSITELGPYT  QDRDSLYNVG  FTQRSSVPTT
21251  SVPGTPTVDL  GTSGTPVSKP  GPSAASPLLV  LFTLNGTITN  LRYEENMQHP
21301  GSRKFNTTER  VLQGLLRSLF  KSTSVGPLYS  GCRLTLLRPE  KDGTATGVDA
21351  ICTHHPDPKS  PRLDREQLYW  ELSQLTHNIT  ELGHYALDND  SLFVNGFTHR
21401  SSVSTTSTPG  TPTVYLGASK  TPASIFGPSA  ASHLLILFTL  NFTITNLRYE
21451  ENMWPGSRKF  NTTERVLQGL  LRPLFKNTSV  GPLYSGSRLT  LLRPEKDGEA
21501  TGVDAICTHR  PDPTGPGLDR  EQLYLELSQL  THSITELGPY  TLDRDSLYVN
21551  GFTHRSSVPT  TSTGVVSEEP  FTLNFTINNL  RYMADMGQPG  SLKFNITDNV
21601  MKHLLSPLFQ  RSSLGARYTG  CRVIALRSVK  NGAETRVDLL  CTYLQPLSGP
21651  GLPIKQVFHE  LSQQTHGITR  LGPYSLDKDS  LYLNGYNEPG  LDEPPTTPKP
21701  ATTFLPPLSE  ATTAMGYHLK  TLTLNFTISN  LQYSPDMGKG  SATFNSTEGV
21751  LQHLLRPLFQ  KSSMGPFYLG  CQLISLRPEK  DGAATGVDTT  CTYHPDPVGP
21801  GLDIQQLYWE  LSQLTHGVTQ  LGFYVLDRDS  LFINGYAPQN  LSIRGEYQIN
21851  FHIVNWNLSN  PDPTSSEYIT  LLRDIQDKVT  TLYKGSQLHD  TFRFCLVTNL
21901  TMDSVLVTVK  ALFSSNLDPS  LVEQVFLDKT  LNASFHWLGS  TYQLVDIHVT
21951  EMESSVYQPT  SSSSTQHFYL  NFTITNLPYS  QDKAQPGTTN  YQRNKRNIED
22001  ALNQLFRNSS  IKSYFSDCQV  STFRSVPNRH  HTGVDSLCNF  SPLARRVDRV
22051  AIYEEFLRMT  RNGTQLQNFT  LDRSSVLVDG  YSPNRNEPLT  GNSDLPFWAV
22101  ILIGLAGLLG  LITCLICGVL  VTTRRRKKEG  EYNVQQQCPG  YYQSHLDLED
22151  LQ
```

SEQUENCE LISTING (315 sequences)

SEQ ID NO: 1 - protein, 13 aa, Homo sapiens
QHPGSRKFKTTEG

SEQ ID NO: 2 - protein, 11 aa, Homo sapiens
FLTVERVLQGL

SEQ ID NO: 3 - protein, 8 aa, Homo sapiens
DTYVGPLY

SEQ ID NO: 4 - protein, 8 aa, Homo sapiens
DGAANGVD

SEQ ID NO: 5 - DNA, 240 bp, Homo sapiens
  CDS (1)..(240)
cgtcgacctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagggtgatgca

SEQ ID NO: 6 - protein, 80 aa, Homo sapiens
RRPGSRKFNTTERVLQGLLRPVFKNTSVGPLYSGCRLTLLRPKKDGAATKVDAICTYRPDPKSPGLDREQLYWELSQGDA

SEQ ID NO: 7 - DNA, 20 bp, Artificial Sequence
  Synthetic Primer
ggagagggttctgcagggtc

SEQ ID NO: 8 - protein, 6 aa, Artificial Sequence
  Synthetic Primer
ERVLQG

SEQ ID NO: 9 - DNA, 20 bp, Artificial Sequence
  Synthetic Primer
gtgaatggtatcaggagagg

SEQ ID NO: 10 - protein, 6 aa, Artificial Sequence
  Synthetic Primer
PLLIPF

SEQ ID NO: 11 - protein, 131 aa, Homo sapiens
ERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASPLLIPFT

SEQ ID NO: 12 - protein, 130 aa, Homo sapiens
ERVLQGLLMPLFKNTSVSSLYSGCRLTLLRPEKDGAATRADAVCTHRPDPKSPGLDRERLYWKLSQLTHGITELGPYTLDRHSLYVNGFTHQSSMTTTRTPDTSTMHLATSRTPASLSGPTTASPLLIPF

SEQ ID NO: 13 - protein, 132 aa, Homo sapiens
ERVLQGLLGPIFKNTSVGPLYSGCRLTSLRSEKDGAATGVDAICIHRLDPKSPGLNREQLYWELSKLTNDIEELGPYTLDRNSLYVNGFTHQSSVSTTSTPGTSTVDLRTSGTPSSLSSPTIMAAGPLLIPF

SEQ ID NO: 14 - protein, 130 aa, Homo sapiens
ERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLIPF

SEQ ID NO: 15 - protein, 130 aa, Homo sapiens
ERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPFLIPF

SEQ ID NO: 16 - protein, 130 aa, Homo sapiens
ERVLQGLLRPLFKSTSAGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLIPF

SEQ ID NO: 17 - protein, 130 aa, Homo sapiens
ERVLQGLLKPLFKSTSVGPLYSGCRLTLLRPEKRGAATGVDTICTHRLDPLNPGLDREQLYWELSKLTRGIIELGPYTLDRDSLYVNGFTHRSSVPTTSIPGTSAVHLETSGTPASLPGHIVPGPLLIPF

SEQ ID NO: 18 - protein, 131 aa, Homo sapiens
ERVLQGLLTPLFKNTSVGPLYSGCRLTLLRPEKQEAATGVDTICTHRVDPIGPGLDRERLYWELSQLTNSITELGPYTLDRDSLYVDGFNPWSSVPTTSTPGTSTVHLATSGTPSPLPGHTAPVPLLIPFT

SEQ ID NO: 19 - protein, 131 aa, Homo sapiens
ERVLQGLLKPLFKNTSVGPLYSGCRLTLLRPEKHEAATGVDTICTHRLDPLNPGLDREQLYWELSKLTRGIIELGPYLLDRGSLYVNGFTHRNFVPITSTPGTSTVHLGTSETPSSLPRPIVPGPLLVPFT

SEQ ID NO: 20 - protein, 130 aa, Homo sapiens
ERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPF

SEQ ID NO: 21 - protein, 131 aa, Homo sapiens
ERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTATGPLLIPFT

SEQ ID NO: 22 - protein, 282 aa, Homo sapiens
ERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPL

SEQ ID NO: 23 - protein, 286 aa, Homo sapiens
ERVLQGLLKPLFRNSSLEYLYSGCRLASLRPEKDSSAMAVDAICTHRPDPEDLGLDRERLYWELSNLTNGIQELGPYTLDRNSLYVNGFTHRSSGLTTSTPWTSTVDLGTSGTPSPVPSPTTAGPLLIPFTLNFTITNLQYEENMGHPGSRKFNIMERVLQGLLMPLFKNTSVSSLYSGCRLTLLRPEKDGAATRVDAVCTQRPDPKSPGLDRERLYWKLSQLTHGITELGPYTLDRHSLYVNGLTHQSSMTTTRTPDTSTMHLATSRTPASLSGPTTASPLLIPF

SEQ ID NO: 24 - protein, 250 aa, Homo sapiens
ERVLQGLLKPLFKSTSVGPLYSGCRLTLLRPEKRGAATGVDTICTHRLDPLNPGLDREQLYWELSKLTRGIIELGPYLLDRGSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIP

SEQ ID NO: 25 - protein, 286 aa, Homo sapiens
ERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPFTINFTITNLRYEENMHHPGSRKFNIMERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLIPF

SEQ ID NO: 26 - protein, 286 aa, Homo sapiens
ERVLQGLLKPLFKSTSVGPLYSGCRLTLLRPEKRGAATGVDTICTHRLDPLNPGLDREQLYWELSKLTRGIIELGPYLLDRGSLYVNGFSRQSSMTTTRTPDTSTMHLATSRTPASLSGPTTASPLLIPFTLNFTITNLQYEENMGHPGSRKFNIMERVLQGLLNPIFKNSSVGPLYSGCRLTSLKPEKDGAATGMDAVCLYHPNPKRPGLDREQLYWELSQLTHGIKELGPYTLDRNSLYVNGFTHRSSVAPTSTPGTSTVDLGTSGTPSSLPSPTTAVPLLIPF

SEQ ID NO: 27 - protein, 286 aa, Homo sapiens
ERVLQGLLKPLFKSTSVGPLYSGCRLTLLRPEKRGAATGVDTICTHRLDPLNPGLDREQLYWELSKLTRGIIELGPYLLDRDSLYVNGFTHRSSVPTTSIPGTSAVHLETFGTPASLHGHTAPGPVLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPF

SEQ ID NO: 28 - protein, 286 aa, Homo sapiens
ERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPF

SEQ ID NO: 29 - protein, 281 aa, Homo sapiens
ERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTHRLDPKSPGVDREQLYWELSQLTNGIKELGPYTLDRNSLYVNGFTHWIPVPTSSTPGTSTVDLGSGTPSSLPSPTTAGPL

SEQ ID NO: 30 - protein, 217 aa, Homo sapiens
ERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTATGPLLIPFTPNFTITNLQYEEDMRRTGSRKFNTMERVLQGLLSPIFKNSSVGPLYSGCRLTSLRPEKDGAATGMDAVCLYHPNPKRPGLDREQLY

SEQ ID NO: 31 - protein, 286 aa, Homo sapiens
ERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQSSMTTTRTPDTSTMHLATSRTPASLSGPTTASPLLIPF

SEQ ID NO: 32 - protein, 288 aa, Homo sapiens
ERVLQGLLGPMFKNTSVGLLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLIPFTINFTITNLRYEENMGHPGSRKFNIMERVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLIPF

SEQ ID NO: 33 - protein, 284 aa, Homo sapiens
ERVLQGLLKPLFKSTSVGPLYSGCRLTLLRPEKDGAATGMDAVCLYHPNPKRPGLDREQLYCELSQLTHDITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSIHELGPYTLDRDSLYVNGFNPRSSVPTTSTPGTSTVHLATSGTPSSLPGHTAPVPLLI

SEQ ID NO: 34 - protein, 288 aa, Homo sapiens
ERVLQGLLSPISKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTVNFTITNLRYEENMHHPGSRKFNTTERVLQGLLRPVFKNTSVGPLYSGCRLTLLRPKKDGAATKVDAICTYRPDPKSPGLDREQLYWELSKLTNDIEELGPYTLDRNSLYVNGFTHQSSVSTTSTPGTSTVDLRTSGTPSSLSSPTIMAAGPLLIPF

SEQ ID NO: 35 - protein, 274 aa, Homo sapiens
ERVLQGLLSPIFKNSSVGSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLP

SEQ ID NO: 36 - protein, 386 aa, Homo sapiens
ERVLQGLLGPMFKNTSVGLLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSVSSLYSGCRLTLLRPEKDGAATRVDAACTYRPDPKSPGLDREQLYWELSQLTHSITELGPYTLDRVSLYVNGFNPRSSVPTTSTPGTSTVHLATSGTPSSLPGHTAPVPLLIPFTLNFTITNLQYEEDMRHPGSRKFNTMERVLQGLLRPLFKNTSIGPLYSSCRLTLLRPEKDKAATRVDAICTHHPDPQSPGLNREQLYWELSQLTHGITEL

SEQ ID NO: 37 - protein, 438 aa, Homo sapiens
ERVLHGLLTPLFKNTRVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKNTSVGPLYSGCRLTLFKPEKHEAATGVDAICTLRLDPTGPGLDRERLYWELSQLTNSVTELGPYTLDRDSLYVNGFTHRSSVPTTSIPGTSAVHLETSGTPASLPGHTAPGPLLIPFTLNFTITNLQYEEDMRRTGSRKFNTMERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSEIHPSLPRPIVPGPL

SEQ ID NO: 38 - protein, 420 aa, Homo sapiens
GPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTLNFTITNLQYEENMGHPGSRKFNITESVLQGLLTPLFKNSSVGPLYSGCRLISLRSEKDGAATGVDAICTHHLNPQSPGLDREQLYWQLSQMTNGIKELGPYTLDRDSLYVNGFTHRSLGLTTSTPWTSTVDLGTSGTPSPVPSPTTAGPLLIPFTLNFTITNLQYEENMGHPGSRKFNIMERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASP

SEQ ID NO: 39 - protein, 439 aa, Homo sapiens
ERVLQGPLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTLNFTITNLQYEENMGHPGSRKFNITERVLQGLLNPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTEPGPLLIPFTLNFTITNLQYEEDMRRTGSRKFNTMERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLL

SEQ ID NO: 40 - protein, 424 aa, Homo sapiens
TSVGPLYSGCRLTLLRSEKDGAATGVDAIYTHRLDPKSPGVDREQLYWELSQLTNGIKELGPYTLDRNSLYVNGFTHQTSAPNTSTPGTSTVDLGTSGTPSSLPSPTSAGPLLIPFTINFTITNLRYEENMHHPGSRKFNTMERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTIINLQYEEDMHRPGSRKFNTTERVLQGLLKPLFKSTSVGPLYSGCRLTLLRPEKHGAATGVDAICTLRLDPTGPGLDRERLYWELSQLTNSITELGPYTLDRDSLYVNGFNPWSSVPTTSTPGTSTVHLATSGTPSSLPGHTAPVPL

SEQ ID NO: 41 - protein, 418 aa, Homo sapiens
TLLRPKKDGVATGVDAICTHRLDPKSPGLNREQLYWELSKLTNDIEELGPYTLDRNSLYVNGFTHQSSVSTTSTPGTSTVDLRTSGTPSSLSSPTIMAAGPLLIPFTINFTITNLRYEENMHHPGSRKFNTMERVLQGLLMPLFKNTSVSSLYSGCRLTLLRPEKDGAATRVDAVCTHRPDPKSPGLDRERLYWKLSQLTHGITELGPYTLDRNSLYVNGFTHRSSMPTTSTPGTSTVDVGTSGTPSSSPSPTTAGPLLMPFTLNFTITNLQYEEDMRRTGSRKFNTMERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLIPF

SEQ ID NO: 42 - protein, 443 aa, Homo sapiens
ERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTIINLQYEEDMHRPGSRKFNTTERVLQGLLMPLFKNTSVGPLYSGCRLTLLRPEKQEAATGVDTICTHRLDPSEPGLDREQLYWELSQLTNSITELGPYTLDRDSLYVNGFTHSGVLCPPPSILGIFTVQPETFETPSSLPGPTATGPVLLPFTLNFTIINLQYEEDMHRPGSRKFNTTERVLQGLLMPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPF

SEQ ID NO: 43 - protein, 442 aa, Homo sapiens
ERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPKKDGAATGVDAICTHRLDPKSPGLNREQLYWELSKLTNDIEEVGPYTLDRNSLYVNGFTHRSFVAPTSTLGTSTVDLGTSGTPSSLPSPTTGVPLLIPFTLNFTITNLQYEENMGHPGSRKFNIMERVLQGLLMPLFKNTSVSSLYSGCRLTLLRPEKDGAATRVVAVCTHRPDPKSPGLDRERLYWKLSQLTHGITELGPYTLDRHSLYVNGFTHQSSMTTTRTPDTSTMHLATSRTPASLSGPTTASPLLIPF

SEQ ID NO: 44 - protein, 442 aa, Homo sapiens
ERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPFTLNFTITNLQYEENMGHPGSRKFNITERVLQGLLKPLFRNSSLEYLYSGCRLTSLRPEKDSSTMAVDAICTHRPDPEDLGLDRERLYWELSNLTNGIQELGPYTLDRNSLYVNGFTHRSFMPTTSTLGTSTVDVGTSGTPSSSPSPTTAGPLLMPFTLNFTITNLQYEEDMRRTGSRKFNTMESVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDPRTSGTPSSLSSPTIMAAGPLLI

SEQ ID NO: 45 - protein, 379 aa, Homo sapiens
ERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLIPFTLNFTITNLKYEEDMHCPGSRKFNTTERVLQSLFGPMFKNTSVGPLYSGCRLTLFRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMRRTGSRKFNTMESVLQGLLKPLFKNTSVGPLYSGCRLTLLRPEKDGAATGVDAICTHRLDPKSPGLNREQLYWELSKL

SEQ ID NO: 46 - protein, 439 aa, Homo sapiens
  MISC_FEATURE (1)..(439): Any "X" = any amino acid
ERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLIPFTLNFTITNLHYEENMQHPGSRKFNTMERVLQGCLVPCSRNTNVGLLYSGCRLTLLXXXXXXXXXXXXXXXXXXXXXXXXXXXXXXXXXXXXXXXXXXXXXGPYTLDRNSLYVNGFTHRSSVAPTSTPGTSTVDLGTSGTPSSLPSPTTVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQVTNGIKELGPYTLDRNSLYVNGFTHRSSGLTTSTPWTSTVDLGTSGTPSPVPSPTTAGPLLI

SEQ ID NO: 47 - protein, 1366 aa, Homo sapiens
ERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMERVLQGPLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTLNFTITNLQYEENMGHPGSRKFNITERVLQGLLNPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTEPGPLLIPFTLNFTITNLQYEEDMRRTGSRKFNTMERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPFTLNFTITNLQYEENMGHPGSRKFNITERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPKKDGAATGVDAICTHRLDPKSPGLNREQLYWELSKLTNDIEEVGPYTLDRNSLYVNGFTHRSFVAPTSTLGTSTVDLGTSGTPSSLPSPTTGVPLLIPFTLNFTITNLQYEENMGHPGSRKFNIMERVLQGLLSPIFKNSSVGSLYSGCRLTLLRPEKDGAATRVDAVCTHRPDPKSPGLDRERLYWKLSQLTHGIIELGPYTLDRHSFYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLP

SEQ ID NO: 48 - protein, 1148 aa, Homo sapiens
MPLFKNTSVSSLYSGCRLTLLRPEKDGAATRVDAVCTHRPDPKSPGLDRERLYWKLSQLTHGIIELGPYTLDRHSFYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 49 - DNA, 6833 bp, Homo sapiens
gagagggttctgcagggtctgctcaaacccttgttcaggaatagcagtctggaatacctctattcaggctgcagactagcctcactcaggccagagaaggatagctcagccatggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacgactgctggccctctcctgatgccgttcaccctcaacttcaccatcaccaacctgcagtacgaggaggacatgcgtcgcactggctccaggaagttcaacaccatggagagggttctgcagggtccgcttagtcccatattcaagaactccagtgttggccctctgtactctggctgcagactgacctctctcaggcccgagaaggatggggcagcaactggaatggatgctgtctgcctctaccaccctaatcccaaaagacctgggctggacagagagcagctgtactgggagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacacagagcctggccctctcctgataccattcacgctcaacttcaccatcactaacctacagtatgaggagaacatgggtcaccctggctccaggaagttcaacatcacggagagggttctgcagggtctgcttaatcccattttcaagaactccagtgttggccctctgtactctggctgcagactgacctctctcaggcccgagaaggatggggcagcaactggaatggatgctgtctgcctctaccaccctaatcccaaaagacctgggctggacagagagcagctgtactgcgagctaagccagctgacccacaacatcactgagctgggcccctacagcttggacagggacagtctttatgtcaatggtttcacccatcagaactctgtgcccaccaccagtactcctgggacctccacagtgtactgggcaaccactgggactccatcctccttccccggccacacagagcctggccctctcctgataccattcaccctcaacttcaccatcaccaacctgcagtacgaggaggacatgcgtcgcactggctccaggaagttcaacaccatggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccatcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactggacagagagcagctatactgggagctgagcaaactgacccgtggcatcatcgagctgggcccctacctcctggacagaggcagtctctatgtcaatggtttcacccatcggaactttgtgcccatcaccagcactcctgggacctccacagtacacctaggaacctctgaaactccatcctccctacctagacccatagtgcctggccctctcctgataccattcacactcaacttcaccatcactaacctacagtatgaggagaacatgggtcaccctggctccaggaagttcaacatcacggagagggttctgcagggtctgctcaaacccttgttcaggaatagcagtctggaatacctctattcaggctgcagactaacctcactcaggccagagaaggatagctcaaccatggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacgactgctggccctctcctgatgccgttcaccctcaacttcaccatcaccaacctgcagtacgaggaggacatgcgtcgcactggctccaggaagttcaacaccatggagagtgtcctgcagggtctgctcaagcccttgttcaagaacaccagtgttggccctctgtactctggctgcagattgaccttgctcaggcccaagaaagatggggcagccactggagtggatgccatctgcacccaccgccttgaccccaaaagccctggactcaacagggagcagctgtactgggagttaagcaaactgaccaatgacattgaagaggtgggcccctacaccttggacaggaacagtctctatgtcaatggtttcacccatcggagctttgtggcccccaccagcactcttgggacctccacagtggaccttgggacctcagggactccatcctccctccccagccccacaacaggtgttcctctcctgataccattcacactcaacttcaccatcactaacctacagtatgaggagaacatgggtcaccctggctccaggaagttcaacatcatggagagggttctgcagggtctgcttatgcccttgttcaagaacaccagtgtcagctctctgtactctggttgcagactgaccttgctcaggcctgagaaggatggggcagccaccagagtggttgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacgaccgccagccctctcctgataccattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggccactatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctccaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgaagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtctagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacccgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcttcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcg

SEQ ID NO: 50 - protein, 2248 aa, Homo sapiens
ERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMERVLQGPLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTLNFTITNLQYEENMGHPGSRKFNITERVLQGLLNPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTEPGPLLIPFTLNFTITNLQYEEDMRRTGSRKFNTMERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPFTLNFTITNLQYEENMGHPGSRKFNITERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPKKDGAATGVDAICTHRLDPKSPGLNREQLYWELSKLTNDIEEVGPYTLDRNSLYVNGFTHRSFVAPTSTLGTSTVDLGTSGTPSSLPSPTTGVPLLIPFTLNFTITNLQYEENMGHPGSRKFNIMERVLQGLLSPIFKNSSVGSLYSGCRLTLLRPEKDGAATRVDAVCTHRPDPKSPGLDRERLYWKLSQLTHGIIELGPYTLDRHSFYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 51 - DNA, 24 bp, Artificial Sequence
  Synthetic Primer
cagcagagaccagcacgagtactc

SEQ ID NO: 52 - DNA, 20 bp, Artificial Sequence
  Synthetic Primer
tccactgccatggctgagct

SEQ ID NO: 53 - DNA, 22 bp, Artificial Sequence
  Synthetic Primer
ccagcacagctcttcccaggac

SEQ ID NO: 54 - DNA, 22 bp, Artificial Sequence
  Synthetic Primer
ggaatggctgagctgacgtctg

SEQ ID NO: 55 - DNA, 21 bp, Artificial Sequence
  Synthetic Primer
cttcccaggacaacctcaagg

SEQ ID NO: 56 - DNA, 21 bp, Artificial Sequence
  Synthetic Primer
gcaggatgagtgagccacgtg

SEQ ID NO: 57 - DNA, 22 bp, Artificial Sequence
  Synthetic Primer
gtcagatctggtgacctcactg

SEQ ID NO: 58 - DNA, 21 bp, Artificial Sequence
  Synthetic Primer
gaggcactggaaagcccagag

SEQ ID NO: 59 - DNA, 25 bp, Artificial Sequence
  Synthetic Primer
ctgatggcattatggaacacatcac

SEQ ID NO: 60 - DNA, 22 bp, Artificial Sequence
  Synthetic Primer
cccagaacgagagaccagtgag

SEQ ID NO: 61 - DNA, 24 bp, Artificial Sequence
  Synthetic Primer
gctgatggcgatgaatgaacactg

SEQ ID NO: 62 - DNA, 22 bp, Artificial Sequence
  Synthetic Primer
cccagaacgagagaccagtgag

SEQ ID NO: 63 - DNA, 35 bp, Artificial Sequence
  Synthetic Primer
cgcggatccgaacactgcgtttgctggctttgatg

SEQ ID NO: 64 - DNA, 23 bp, Artificial Sequence
  Synthetic Primer
cctctgtgtgctgcttcattggg

SEQ ID NO: 65 - DNA, 32 bp, Artificial Sequence
  Synthetic Primer
accggatccatgggccacacagagcctggccc

SEQ ID NO: 66 - DNA, 29 bp, Artificial Sequence
  Synthetic Primer
tgtaagcttaggcagggaggatggagtcc

SEQ ID NO: 67 - DNA, 507 bp, Homo sapien
atgagaggatcgcatcaccatcaccatcacggatccatgggccacacagagcctggccctctcctgataccattcactttcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgaccttgctcagacctgagaagcatgaggcagccactggagtggacaccatctgtacccaccgcgttgatcccatcggacctggactggacagagagcggctatactgggagctgagccagctgaccaacagcatcacagagctgggaccctacaccctggacagggacagtctctatgtcaatggcttcaaccctcggagctctgtgccaaccaccagcactcctgggacctccacagtgcacctggcaacctctgggactccatcctccctgcct

SEQ ID NO: 68 - protein, 169 aa, Homo sapiens
MRGSHHHHHHGSMGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLP

SEQ ID NO: 69 - protein, 909 aa, Homo sapiens
  MISC_FEATURE (1)..(909): Any "X" = any amino acid
ERVLQGLLGPMFKNTSVGLLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLIPFTINFTITNLRYEENMGHPGSRKFNIMERVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLIPFTINFTITNLRYEENMHHPGSRKFNTMERVLQGLLMPLFKNTSVSSLYSGCRLTLLRPEKDGAATRVDAVCTHRPDPKSPGLDRERLYWKLSQLTHGITELGPYTLDRNSLYVNGFTHRSSMPTTSTPGTSTVDVGTSGTPSSSPSPTTAGPLLMPFTLNFTITNLQYEEDMRRTGSRKFNTMERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLIPFTLNFTITNLHYEENMQHPGSRKFNTMERVLQGCLVPCSRNTNVGLLYSGCRLTLLRXEKXXAATXVDXXCXXXXDPXXPGLDREXLYWELSXLTXXIXELGPYTLDRNSLYVNGFTHRSSVAPTSTPGTSTVDLGTSGTPSSLPSPTTVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQVTNGIKELGPYTLDRNSLYVNGFTHRSSGLTTSTPWTSTVDLGTSGTPSPVPSPTTAGPLLI

SEQ ID NO: 70 - protein, 525 aa, Homo sapiens
QGLLGPMFKNTSVGLLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSVSSLYSGCRLTLLRPEKDGAATRVDAACTYRPDPKSPGLDREQLYWELSQLTHSITELGPYTLDRVSLYVNGFNPRSSVPTTSTPGTSTVHLATSGTPSSLPGHTAPVPLLIPFTLNFTITNLQYEEDMRHPGSRKFNTMERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTATGPLLIPFTPNFTITNLQYEEDMRRTGSRKFNTMERVLQGLLSPIFKNSSVGPLYSGCRLTSLRPEKDGAATGMDAVCLYHPNPKRPGLDREQLY

SEQ ID NO: 71 - protein, 594 aa, Homo sapiens
ERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTIINLQYEEDMHRPGSRKFNTTERVLQGLLMPLFKNTSVGPLYSGCRLTLLRPEKQEAATGVDTICTHRLDPSEPGLDREQLYWELSQLTNSITELGPYTLDRDSLYVNGFTHSGVLCPPPSILGIFTVQPETFETPSSLPGPTATGPVLLPFTLNFTIINLQYEEDMHRPGSRKFNTTERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTHRLDPKSPGVDREQLYWELSQLTNGIKELGPYTLDRNSLYVNGFTHWIPVPTSSTPGTSTVDLGSGTPSSLPSPTTAGPL

SEQ ID NO: 72 - protein, 424 aa, Homo sapiens; identical to SEQ ID NO: 40

SEQ ID NO: 73 - protein, 286 aa, Homo sapiens
ERVLQGLLKPLFKSTSVGPLYSGCRLTLLRPEKRGAATGVDTICTHRLDPLNPGLDREQLYWELSKLTRGIIELGPYLLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPF

SEQ ID NO: 74 - protein, 286 aa, Homo sapiens; identical to SEQ ID NO: 31

SEQ ID NO: 75 - protein, 286 aa, Homo sapiens; identical to SEQ ID NO: 26

SEQ ID NO: 76 - protein, 286 aa, Homo sapiens; identical to SEQ ID NO: 23

SEQ ID NO: 77 - protein, 288 aa, Homo sapiens; identical to SEQ ID NO: 34

SEQ ID NO: 78 - protein, 597 aa, Homo sapiens
ERVLHGLLTPLFKNTRVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKNTSVGPLYSGCRLTLFKPEKHEAATGVDAICTLRLDPTGPGLDRQLYWELSQLTNSVTELGPYTLDRDSLYVNGFTHRSSVPTTSIPGTSAVHLETSGTPASLPGHTAPGPLLIPFTLNFTITNLQYEEDMRRTGSRKFNTMERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLIPFTINFTITNLRYEENMHHPGSRKFNIMERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLIPF

SEQ ID NO: 79 - protein, 420 aa, Homo sapiens; identical to SEQ ID NO: 38

SEQ ID NO: 80 - protein, 479 aa, Homo sapiens
QLYWELSKLTNDIEELGPYTLDRNSLYVNGFTHQSSVSTTSTPGTSTVDLRTSGTPSSLSSPTIMAAGPLLIPFTLNFTITNLQYEENMGHPGSRKFNIMERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLIPFTLNFTITNLKYEEDMHCPGSRKFNTTERVLQSLFGPMFKNTSVGPLYSGCRLTLLRSEKDGAATGVDAICTHRLDPKSLGVDREQLYWELSQLTNGIKELGPYTLDRNSLYVNGFTHQTSAPNTSTPGTSTVDLGTSGTPSSLPSPTSAGPLLVPFTLNFTITNLQYEEDMRRTGSRKFNTMESVLQGLLKPLFKNTSVGPLYSGCRLTLLRPEKDGAATGVDAICTHRLDPKSPGLNREQLYWELSKL

SEQ ID NO: 81 - DNA, 5465 bp, Homo sapiens
cagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctttgaagaccaccaccacagctttgaagaccacttccagagccaccttgaccaccagtgtctatactcccactttgggaacactgactcccctcaatgcatcaaggcaaatggccagcacaatcctcacagaaatgatgatcacaaccccatatgttttccctgatgttccagaaacgacatcctcattggctaccagcctgggagcagaaaccagcacagctcttcccaggacaaccccatctgttctcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtcctggggcagaaaccagttcagctattccaattatgactgtctcacctggtgcagaagatctggtgacctcacaggtcactagttctgggacagacagaaatatgactattccaactttgactctttctcctggtgaaccaaagacgatagcctcattagtcacccatcctgaagcacagacaagttcggccattccaacttcaactatctcgcctgctgtatcacggttggtgacctcaatggtcaccagtttggcggcaaagacaagtacaactaatcgagctctgacaaactcccctggtgaaccagctacaacagtttcattggtcacgcatcctgcacagaccagcccaacagttccctggacaacttccatttttttccatagtaaatcagacaccacaccttcaatgaccaccagtcatggggcagaatccagttcagctgttccaactccaactgtttcaactgaggtaccaggagtagtgacccctttggtcaccagttctagggcagtgatcagtacaactattccaattctgactctttctcctggtgaaccagagaccacaccttcaatggccaccagtcatggggaagaagccagttctgctattccaactccaactgtttcacctggggtaccaggagtggtgacctctctggtcactagttctagggcagtgactagtacaactattccaattctgactttttctcttggtgaaccagagaccacaccttcaatggccaccagtcatgggacagaagctggctcagctgttccaactgttttacctgaggtaccaggaatggtgacctctctggttgctagttctagggcagtaaccagtacaactcttccaactctgactctttctcctggtgaaccagagaccacaccttcaatggccaccagtcatggggcagaagccagctcaactgttccaactgtttcacctgaggtaccaggagtggtgacctctctggtcactagttctagtggagtaaacagtacaagtattccaactctgattctttctcctggtgaactagaaaccacaccttcaatggccaccagtcatggggcagaagccagctcagctgttccaactccaactgtttcacctggggtatcaggagtggtgacccctctggtcactagttccagggcagtgaccagtacaactattccaattctaactctttcttctagtgagccagagaccacaccttcaatggccaccagtcatggggtagaagccagctcagctgttctaactgtttcacctgaggtaccaggaatggtgacctctctggtcactagttctagagcagtaaccagtacaactattccaactctgactatttcttctgatgaaccagagaccacaacttcattggtcacccattctgaggcaaagatgatttcagccattccaactttagctgtctcccctactgtacaagggctggtgacttcactggtcactagttctgggtcagagaccagtgcgttttcaaatctaactgttgcctcaagtcaaccagagaccatagactcatgggtcgctcatcctgggacagaagcaagttctgttgttccaactttgactgtctccactggtgagccgtttacaaatatctcattggtcacccatcctgcagagagtagctcaactcttcccaggacaacctcaaggttttcccacagtgaattagacactatgccttctacagtcaccagtcctgaggcagaatccagctcagccatttcaactactatttcacctggtataccaggtgtgctgacatcactggtcactagctctgggagagacatcagtgcaacttttccaacagtgcctgagtccccacatgaatcagaggcaacagcctcatgggttactcatcctgcagtcaccagcacaacagttcccaggacaacccctaattattctcatagtgaaccagacaccacaccatcaatagccaccagtcctggggcagaagccacttcagattttccaacaataactgtctcacctgatgtaccagatatggtaacctcacaggtcactagttctgggacagacaccagtataactattccaactctgactctttcttctggtgagccagagaccacaacctcatttatcacctattctgagacacacacaagttcagccattccaactctccctgtctcccctggtgcatcaaagatgctgacctcactggtcatcagttctgggacagacagcactacaactttcccaacactgacggagaccccatatgaaccagagacaacagccatacagctcattcatcctgcagagaccaacacaatggttcccaagacaactcccaagttttcccatagtaagtcagacaccacactcccagtagccatcaccagtcctgggccagaagccagttcagctgtttcaacgacaactatctcacctgatatgtcagatctggtgacctcactggtccctagttctgggacagacaccagtacaaccttcccaacattgagtgagaccccatatgaaccagagactacagtcacgtggctcactcatcctgcagaaaccagcacaacggtttctgggacaattcccaacttttcccataggggatcagacactgcaccctcaatggtcaccagtcctggagtagacacgaggtcaggtgttccaactacaaccatcccacccagtataccaggggtagtgacctcacaggtcactagttctgcaacagacactagtacagctattccaactttgactccttctcctggtgaaccagagaccacagcctcatcagctacccatcctgggacacagactggcttcactgttccaattcggactgttccctctagtgagccagatacaatggcttcctgggtcactcatcctccacagaccagcacacctgtttccagaacaacctccagtttttcccatagtagtccagatgccacacctgtaatggccaccagtcctaggacagaagccagttcagctgtactgacaacaatctcacctggtgcaccagagatggtgacttcacagatcactagttctggggcagcaaccagtacaactgttccaactttgactcattctcctggtatgccagagaccacagccttattgagcacccatcccagaacagggacaagtaaaacatttcctgcttcaactgtgtttcctcaagtatcagagaccacagcctcactcaccattagacctggtgcagagactagcacagctctcccaactcagacaacatcctctctcttcaccctacttgtaactggaaccagcagagttgatctaagtccaactgcttcacctggtgtttctgcaaaaacagccccactttccacccatccagggacagagaccagcacaatgattccaacttcaactctttcccttggtttactagagactacaggcttactggccaccagctcttcagcagagaccagcacgagtactctaactctgactgtttcccctgctgtctctgggctttccagtgcctctataacaactgataagccccaaactgtgacctcctggaacacagaaacctcaccatctgtaacttcagttggacccccagaattttccaggactgtcacaggcaccactatgaccttgataccatcagagatgccaacaccacctaaaaccagtcatggagaaggagtgagtccaaccactatcttgagaactacaatggttgaagccactaatttagctaccacaggttccagtcccactgtggccaagacaacaaccaccttcaatacactggctggaagcctctttactcctctgaccacacctgggatgtccaccttggcctctgagagtgtgacctcaagaacaagttataaccatcggtcctggatctccaccaccagcagttataaccgtcggtactggacccctgccaccagcactccagtgacttctacattctccccagggatttccacatcctccatccccagctccacagcagccacagtcccattcatggtgccattcaccctcaacttcaccatcaccaacctgcagtacgaggaggacatgcggcaccctggttccaggaagttcaacgccacagagagagaactgcagggtctgctcaaacccttgttcaggaatagcagtctggaatacctctattcaggctgcagactagcctcactcaggccagagaaggatagctcagccatggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacg

SEQ ID NO: 82 - protein, 1821 aa, Homo sapiens
ESVLEGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASRQMASTILTEMMITTPYVFPDVPETTSSLATSLGAETSTALPRTTPSVLNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPT

SEQ ID NO: 83 - DNA, 468 bp, Homo sapiens
gccacagtcccattcatggtgccattcaccctcaacttcaccatcaccaacctgcagtacgaggaggacatgcggcaccctggttccaggaagttcaacgccacagagagagaactgcagggtctgctcaaacccttgttcaggaatagcagtctggaatacctctattcaggctgcagactagcctcactcaggccagagaaggatagctcagccatggcagtggatgccatctgcatacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacg

SEQ ID NO: 84 - DNA, 474 bp, Homo sapiens
gctgctggccctctcctgatgccgttcaccctcaacttcaccatcaccaacctgcagtacgaggaggacatgcgtcgcactggctccaggaagttcaacaccatggagagtgtcctgcagggtctgctcaagcccttgttcaagaacaccagtgttggccctctgtactctggctgcagattgaccttgctcaggcccaagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtttcacccatcagagctctgtgtccaccaccagcactcctgggacctccacagtggatctcagaacctcagggactccatcctccctctccagccccacaattatg

SEQ ID NO: 85 - DNA, 468 bp, Homo sapiens
gctgctggccctctcctggtaccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtctgagaaggatggagcagccactggagtggatgccatctgcatccatcatcttgaccccaaaagccctggactcaacagagagcggctgtactgggagctgagccaactgaccaatggcatcaaagagctgggcccctacaccctggacaggaacagtctctatgtcaatggtttcacccatcggacctctgtgcccaccaccagcactcctgggacctccacagtggaccttggaacctcagggactccattctccctcccaagccccgca

SEQ ID NO: 86 - DNA, 465 bp, Homo sapiens
actgctggccctctcctggtgctgttcaccctcaacttcaccatcaccaacctgaagtatgaggaggacatgcatcgccctggctccaggaagttcaacaccactgagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggactggacagagagcagctatactgggagctgagccagctgaccaatggcatcaaagagctgggcccctacaccctggacaggaacagtctctatgtcaatggtttcacccattggatccctgtgcccaccagcagcactcctgggacctccacagtggaccttgggtcagggactccatcctccctccccagccccaca

SEQ ID NO: 87 - DNA, 468 bp, Homo sapiens
gctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctaca

SEQ ID NO: 88 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacaccagtgttggccctctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctaca

SEQ ID NO: 89 - DNA, 468 bp, Homo sapiens
tctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcaacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccaca

SEQ ID NO: 90 - DNA, 468 bp, Homo sapiens
acagctgttcctctcctggtgccgttcaccctcaactttaccatcaccaatctgcagtatggggaggacatgcgtcaccctggctccaggaagttcaacaccacagagagggtcctgcagggtctgcttggtcccttgttcaagaactccagtgtcggccctctgtactctggctgcagactgatctctctcaggtctgagaaggatggggcagccactggagtggatgccatctgcacccaccaccttaaccctcaaagccctggactggacagggagcagctgtactggcagctgagccagatgaccaatggcatcaaagagctgggcccctacaccctggaccggaacagtctctacgtcaatggtttcacccatcggagctctgggctcaccaccagcactccttggacttccacagttgaccttggaacctcagggactccatcccccgtccccagccccaca

SEQ ID NO: 91 - DNA, 468 bp, Homo sapiens
actgctggccctctcctggtgccattcaccctcaacttcaccatcaccaacctgcagtatgaggaggacatgcatcgccctggatctaggaagttcaacaccacagagagggtcctgcagggtctgcttagtcccattttcaagaactccagtgttggccctctgtactctggctgcagactgacctctctcaggcccgagaaggatggggcagcaactggaatggatgctgtctgcctctaccaccctaatcccaaaagacctggactggacagagagcagctgtactgggagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacaca

SEQ ID NO: 92 - DNA, 468 bp, Homo sapiens
gagcctggccctctcctgataccattcactttcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgacctctctcaggcccgagaaggatggggcagcaactggaatggatgctgtctgcctctaccaccctaatcccaaaagacctgggctggacagagagcagctgtactgggagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacaca

SEQ ID NO: 93 - DNA, 468 bp, Homo sapiens
gagcctggccctctcctgataccattcactttcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgaccttgctcagacctgagaagcatgaggcagccactggagtggacaccatctgtacccaccgcgttgatcccatcggacctggactggacagggagcggctatactgggagctgagccagctgaccaacagcattaccgaactgggaccctacaccctggacagggacagtctctatgtcaatggcttcaaccctcggagctctgtgccaaccaccagcactcctgggacctccacagtgcacctggcaacctctgggactccatcctccctgcctggccacaca

SEQ ID NO: 94 - DNA, 468 bp, Homo sapiens
  misc_feature (1)..(468): All N's = any nucleotide
gcccctgtccctctcttgataccattcaccctcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgaccttgctcagacctgagaagcatgaggcagccactggagtggacaccatctgtacccaccgcgttgatcccatcggacctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 95 - DNA, 468 bp, Homo sapiens
tctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcgacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccaca

SEQ ID NO: 96 - DNA, 468 bp, Homo sapiens; identical to SEQ ID NO: 90

SEQ ID NO: 97 - DNA, 468 bp, Homo sapiens
actgctggccctctcctggtgccattcaccctaaacttcaccatcaccaacctgcagtatgaggaggacatgcatcgccctggatctaggaagttcaacgccacagagagggtcctgcagggtctgcttagtcccatattcaagaactccagtgttggccctctgtactctggctgcagactgacctctctcaggcccgagaaggatggggcagcaactggaatggatgctgtctgcctctaccaccctaatcccaaaagacctggactggacagagagcagctgtactgggagctaagccagctgacccacaacatcactgagctgggcccctacagcctggacagggacagtctctatgtcaatggtttcacccatcagagctctatgacgaccaccagaactcctgatacctccacaatgcacctggcaacctcgagaactccagcctccctgtctggacctacg

SEQ ID NO: 98 - DNA, 474 bp, Homo sapiens
accgccagccctctcctggtgctattcacaatcaactgcaccatcaccaacctgcagtacgaggaggacatgcgtcgcactggctccaggaagttcaacaccatggagagtgtcctgcagggtctgctcaagcccttgttcaagaacaccagtgttggccctctgtactctggctgcagattgaccttgctcaggcccaagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtttcacccatcagagctctgtgtccaccaccagcactcctgggacctccacagtggatctcagaacctcagggactccatcctccctctccagccccacaattatg

SEQ ID NO: 99 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagagggtcctacagggtctgctcaggcccttgttcaagaacaccagtgtcagctctctgtactctggttgcagactgaccttgctcaggcctgagaaggatggggcagccaccagagtggatgctgcctgcacctaccgccctgatcccaaaagccctggactggacagagagcaactatactgggagctgagccagctaacccacagcatcactgagctgggaccctacaccctggacagggtcagtctctatgtcaatggcttcaaccctcggagctctgtgccaaccaccagcactcctgggacctccacagtgcacctggcaacctctgggactccatcctccctgcctggccacaca

SEQ ID NO: 100 - DNA, 468 bp, Homo sapiens
gcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccagcggagctctgtgccaaccaccagtattcctgggacctctgcagtgcacctggaaacctctgggactccagcctccctccctggccacaca

SEQ ID NO: 101 - DNA, 468 bp, Homo sapiens
gcccctggccctctcctggtgccattcaccctcaacttcactatcaccaacctgcagtatgaggtggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactggacagagagcagctatactgggagctgagcaaactgacccgtggcatcatcgagctgggcccctacctcctggacagaggcagtctctatgtcaatggtttcacccatcggaactttgtgcccatcaccagcactcctgggacctccacagtacacctaggaacctctgaaactccatcctccctacctagacccata

SEQ ID NO: 102 - DNA, 468 bp, Homo sapiens
gtgcctggccctctcctggtgccattcaccctcaacttcaccatcaccaacttgcagtatgaggaggccatgcgacaccctggctccaggaagttcaataccacggagagggtcctacagggtctgctcaggcccttgttcaagaataccagtatcggccctctgtactccagctgcagactgaccttgctcaggccagagaaggacaaggcagccaccagagtggatgccatctgtacccaccaccctgaccctcaaagccctggactgaacagagagcagctgtactgggagctgagccagctgacccacggcatcactgagctgggcccctacaccctggacagggacagtctctatgtcgatggtttcactcattggagccccataccgaccaccagcactcctgggacctccatagtgaacctgggaacctctgggatcccaccttccctccctgaaactaca

SEQ ID NO: 103 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagagggttctgcagggtctgctcaaacccttgttcaggaatagcagtctggaatacctctattcaggctgcagactagcctcactcaggccagagaaggatagctcagccatggcagtggatgccatctgcacacatcgccctgaccctgaagacctcggactggacagagagcgactgtactgggagctgagcaatctgacaaatggcatccaggagctgggcccctacaccctggaccggaacagtctctacgtcaatggtttcacccatcggagctctgggctcaccaccagcactccttggacttccacagttgaccttggaacctcagggactccatcccccgtccccagccccaca

SEQ ID NO: 104 - DNA, 468 bp, Homo sapiens
actgctggccctctcctggtgccattcaccctcaacttcaccatcaccaacctgcagtatgaggaggacatgcatcgccctggttccaggaggttcaacaccacggagagggttctgcagggtctgctcacgcccttgttcaagaacaccagtgttggccctctgtactctggctgcagactgaccttgctcagacctgagaagcaagaggcagccactggagtggacaccatctgtacccaccgcgttgatcccatcggacctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacaca

SEQ ID NO: 105 - DNA, 468 bp, Homo sapiens
gcccctgtccctctcttgataccattcaccctcaactttaccatcaccgacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccatcggagctctgtgccaaccaccagtattcctgggacctctgcagtgcacctggaaacctctgggactccagcctccctccctggccacaca

SEQ ID NO: 106 - DNA, 468 bp, Homo sapiens
gcccctggccctctcctggtgccattcaccctcaacttcactatcaccaacctgcagtatgaggaggacatgcgtcaccctggttccaggaagttcagcaccacggagagagtcctgcagggtctgctcaagcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacg

SEQ ID NO: 107 - DNA, 468 bp, Homo sapiens
accgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccacgctcaggcccaagaaggatggggcagccaccaaagtggatgccatctgcacctaccgccctgatcccaaaagccctggactggacagagagcagctatactgggagctgagccagctaacccacagcatcactgagctgggcccctacacccaggacagggacagtctctatgtcaatggcttcacccatcggagctctgtgccaaccaccagtattcctgggacctctgcagtgcacctggaaacctctgggactccagcctccctccctggccacaca

SEQ ID NO: 108 - DNA, 468 bp, Homo sapiens
gcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaacccaggactggacagagagcagctatactgggagctgagcaaactgacccgtggcatcatcgagctgggcccctacctcctggacagaggcagtctctatgtcaatggtttcacccatcggacctctgtgcccaccaccagcactcctgggacctccacagtggaccttggaacctcagggactccattctccctcccaagccccgca

SEQ ID NO: 109 - DNA, 465 bp, Homo sapiens
  misc_feature (1)..(465): All N's = any nucleotide
ncnnctgnccctctcctgntnccnttcaccntcaacttnaccatcaccaacctgcantangnggannacatgcnncncccnggntccaggaagttcaacaccacngagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggagtggacagggagcaactatactgggagctgagccagctgaccaatggcattaaagaactgggcccctacaccctggacaggaacagtctctatgtcaatgggttcacccattggatccctgtgcccaccagcagcactcctgggacctccacagtggaccttgggtcagggactccatcctccctccccagccccaca

SEQ ID NO: 110 - DNA, 468 bp, Homo sapiens
actgctggccctctcctggtgccgttcaccctcaacttcaccatcaccaacctgaagtacgaggaggacatgcattgccctggctccaggaagttcaacaccacagagagagtcctgcagagtctgcttggtcccatgttcaagaacaccagtgttggccctctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctaca

SEQ ID NO: 111 - DNA, 465 bp, Homo sapiens
  misc_feature (1)..(465): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccattggatccctgtgcccaccagcagcactcctgggacctccacagtggaccttgggtcagggactccatcctccctccccagccccaca

SEQ ID NO: 112 - DNA, 468 bp, Homo sapiens
  misc_feature (1)..(468): All N's = any nucleotide
actgctggccctctcctggtgccgttcaccctcaacttcaccatcaccaacctgaagtacgaggaggacatgcattgccctggctccaggaagttcaacaccacagagagagtcctgcagagtctgcttggtcccatgttcaagaacaccagtgttggccctctgtactctggctgcagactgacctcgctcaggtccgagaaggatggagcagccactggagtggatgccatctgcacccaccgtgttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtgnacntnggnacctcngggactccatcctccntccccngccncaca

SEQ ID NO: 113 - DNA, 468 bp, Homo sapiens
  misc_feature (1)..(468): All N's = any nucleotide
tctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcaaccactggaatggatgccatctgcacccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 114 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagagggttctgcagggtctgctcaaacccttgttcaggaatagcagtctggaatacctctattcaggctgcagactagcctcactcaggccagagaaggatagctcagccatggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacg

SEQ ID NO: 115 - DNA, 468 bp, Homo sapiens
actgctggccctctcctgataccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtctgagaaggatggagcagccactggagtggatgccatctgcatccatcatcttgaccccaaaagccctggactcaacagagagcggctgtactgggagctgagccaactgaccaatggcatcaaagagctgggcccctacaccctggacaggaacagtctctatgtcaatggtttcacccatcggacctctgtgcccaccaccagcactcctgggacctccacagtggaccttggaacctcagggactccattctccctcccaagccccgca

SEQ ID NO: 116 - DNA, 468 bp, Homo sapiens
  misc_feature (1)..(468): All N's = any nucleotide
actgctggccctctcctggtgctgttcaccctcaacttcaccatcaccaacctgaagtatgaggaggacatgcatcgccctggctccaggaagttcaacaccactgagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 117 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacacccaggacagggacagtctctatgtcaatggcttcacccatcggagctctgtgccaaccaccagtattcctgggacctctgcagtgcacctggaaaccactgggactccatcctccttccccggccacaca

SEQ ID NO: 118 - DNA, 468 bp, Homo sapiens
gagcctggccctctcctgataccattcactttcaactttaccatcaccaacctgcgttatgaggaaaacatgcaacaccctggttccaggaagttcaacaccacggagagggttctgcagggtctgctcacgcccttgttcaagaacaccagtgttggccctctgtactctggctgcagactgaccttgctcagacctgagaagcaggaggcagccactggagtggacaccatctgtacccaccgcgttgatcccatcggacctggactggacagagagcggctatactgggagctgagccagctgaccaacagcatcacagagctgggaccctacaccctggatagggacagtctctatgtcgatggcttcaacccttggagctctgtgccaaccaccagcactcctgggacctccacagtgcacctggcaacctctgggactccatcccccctgcctggccacaca

SEQ ID NO: 119 - DNA, 468 bp, Homo sapiens
gcccctgtccctctcttgataccattcaccctcaactttaccatcaccgacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacaca

SEQ ID NO: 120 - DNA, 468 bp, Homo sapiens
  misc_feature (1)..(468): All N's = any nucleotide
actgctggccctctcctggtgccgttcaccctcaacttcaccatcaccaacctgaagtacgaggaggacatgcattgccctggctccaggaagttcaacaccacagagagagtcctgcagagtctgcatggtcccatgttcaagaacaccagtgttggccctctgtactctggctgcagactgaccttgctcaggtccgagaaggatggagcagccactggagtggatgccatctgcacccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 121 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaacagcatcacagagctgggaccctacaccctggatagggacagtctctatgtcaatggtttcacccatcgaagctctatgcccaccaccagtattcctgggacctctgcagtgcacctggaaacctctgggactccagcctccctccctggccacaca

SEQ ID NO: 122 - DNA, 468 bp, Homo sapiens
  misc_feature (1)..(468): All N's = any nucleotide
gcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 123 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggttttcaccctcggagctctgtgccaaccaccagcactcctgggacctccacagtgcacctggcaacctctgggactccatcctccctgcctggccacaca

SEQ ID NO: 124 - DNA, 468 bp, Homo sapiens
  misc_feature (1)..(468): All N's = any nucleotide
gcccctgtccctctcttgataccattcaccctcaactttaccatcaccaacctgcattatgaagaaaacatgcaacaccctggttccaggaagttcaacaccacggagcgggtcctgcagggtctgcttggtcccatgttcaagaacacaagtgtcggccttctgtactctggctgcagactgaccttgctcaggcctgagaagaatggggcagccactggaatggatgccatctgcagccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 125 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcagaactctgtgcccaccaccagtactcctgggacctccacagtgtactgggcaaccactgggactccatcctccttccccggccacaca

SEQ ID NO: 126 - DNA, 468 bp, Homo sapiens
  misc_feature (1)..(468): All N's = any nucleotide
gagcctggccctctcctgataccattcactttcaactttaccatcaccaacctgcattatgaggaaaacatgcaacaccctggttccaggaagttcaacaccacggagagggttctgcagggtctgctcacgcccttgttcaagaacaccagtgttggccctctgtactctggctgcagactgaccttgctcagacctgagaagcaggaggcagccactggagtggacaccatctgtacccaccgcgttgatcccatcggacctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 127 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcggagctctgtgccaaccaccagcagtcctgggacctccacagtgcacctggcaacctctgggactccatcctccctgcctggccacaca

SEQ ID NO: 128 - DNA, 468 bp, Homo sapiens
  misc_feature (1)..(468): All N's = any nucleotide
gcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagtgttggccctctgtactctggctgcagactgaccttgctcagacctgagaaacatggggcagccactggagtggacgccatctgcaccctccgccttgatcccactggtcctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 129 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcggacctctgtgcccaccaccagcactcctgggacctccacagtgcacctggcaacctctgggactccatcctccctgcctggccacaca

SEQ ID NO: 130 - DNA, 468 bp, Homo sapiens
  misc_feature (1)..(468): All N's = any nucleotide
gcccctgtccctctcttgataccattcaccctcaactttaccatcaccaacctgcagtatgaggaggacatgcatcgccctggatctaggaagttcaacaccacagagagggtcctgcagggtctgcttagtcccattttcaagaactccagtgttggccctctgtactctggctgcagactgacctctctcaggcccgagaaggatggggcagcaactggaatggatgctgtctgcctctaccaccctaatcccaaaagacctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 131 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccattggagctctgggctcaccaccagcactccttggacttccacagttgaccttggaacctcagggactccatcccccgtccccagccccaca

SEQ ID NO: 132 - DNA, 468 bp, Homo sapiens
  misc_feature (1)..(468): All N's = any nucleotide
actgctggccctctcctggtgccattcaccctaaacttcaccatcaccaacctgcagtatgaggaggacatgcatcgccctggatctaggaagttcaacgccacagagagggtcctgcagggtctgcttagtcccatattcaagaacaccagtgttggccctctgtactctggctgcagactgaccttgctcagacctgagaagcaggaggcagccactggagtggacaccatctgtacccaccgcgttgatcccatcggacctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 133 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcggagctttgggctcaccaccagcactccttggacttccacagttgaccttggaacctcagggactccatcccccgtccccagccccaca

SEQ ID NO: 134 - DNA, 468 bp, Homo sapiens
  misc_feature (1)..(468): All N's = any nucleotide
actgctggccctctcctggtgccattcaccctaaacttcaccatcaccaacctgcagtatgaggaggacatgcatcgccctggctccaggaagttcaacaccacggagagggtccttcagggtctgcttacgcccttgttcaggaacaccagtgtcagctctctgtactctggttgcagactgaccttgctcaggcctgagaaggatggggcagccaccagagtggatgctgtctgcacccatcgtcctgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 135 - DNA, 465 bp, Homo sapiens; identical to SEQ ID NO: 111
  misc_feature (1)..(465): All N's = any nucleotide

SEQ ID NO: 136 - DNA, 468 bp, Homo sapiens
  misc_feature (1)..(468): All N's = any nucleotide
actgctggccctctcctggtaccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtccgagaaggatggagcagccactggagtggatgccatctgcatccatcatcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 137 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcagacctttgcgcccaacaccagcactcctgggacctccacagtggaccttgggacctcagggactccatcctccctccccagccctaca

SEQ ID NO: 138 - DNA, 468 bp, Homo sapiens
  misc_feature (1)..(468): All N's = any nucleotide
tctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccaccagagtggatgctgtctgcacccatcgtcctgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncaca

SEQ ID NO: 139 - DNA, 468 bp, Homo sapiens
  misc_feature (1)..(468): All N's = any nucleotide
ncnnctgnccctctcctgntnccnttcaccntcaacttnaccatcaccaacctgcantangnggannacatgcnncncccnggntccaggaagttcaacaccacngagagggttctgcagggtctgctcaagcccttgttcaagagcaccagtgttggccctctgtattctggctgcagactgaccttgctcaggcctgagaaggacggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccaca

SEQ ID NO: 140 - DNA, 468 bp, Homo sapiens
gccactggccctgtcctgctgccattcaccctcaattttaccatcactaacctgcagtatgaggaggacatgcatcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacg

SEQ ID NO: 141 - DNA, 468 bp, Homo sapiens
accgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcg

SEQ ID NO: 142 - DNA, 468 bp, Homo sapiens
gctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggccactatgccctggacaacgacagcctctttgtcaatggtttcactcatcggagctctgtgtccaccaccagcactcctgggacccccacagtgtatctgggagcatctaagactccagcctcgatatttggcccttca

SEQ ID NO: 143 - DNA, 399 bp, Homo sapiens
gctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctccaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagc

SEQ ID NO: 144 - DNA, 453 bp, Homo sapiens
accggggtggtcagcgaggagccattcacactgaacttcaccatcaacaacctgcgctacatggcggacatgggccaacccggctccctcaagttcaacatcacagacaacgtcatgaagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtctagatgagcctcctacaactcccaagccagccaccacattcctgcctcctctgtcagaagccacaaca

SEQ ID NO: 145 - DNA, 465 bp, Homo sapiens
gccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtac

SEQ ID NO: 146 - protein, 9799 aa, Homo sapiens
  MISC_FEATURE (1)..(9799): Any "X" = any amino acid
ATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTAAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREQLYWELSQLTNGIKELGPYTLDRNSLYVNGFTHWIPVPTSSTPGTSTVDLGSGTPSSLPSPTAAGPLLVPFTLNFTITNLQYEEDMHHPGSRKFNTTERVLQGLLGPMFKNTSVGLLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMRHPGSRKFNTTERVLQGLLKPLFKSTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLPGHTAPVPLLIPFTLNFTITNLHYEENMQHPGSRKFNTTERVLQGLLKPLFKNTSVGPLYSGCRLTLLRPEKHEAATGVDTICTHRVDPIGPGLDREXLYWELSXLTXXIXELGPYXLDRXSLYVNGFXXXXXXXXTSTPGTSXVXLXTSGTPXXXPXXTSAGPLLVPFTLNFTITNLQYEEDMHHPGSRKFNTTERVLQGLLGPMFKNTSVGLLYSGCRLTLLRPEKNGAATGMDAICSHRLDPKSPGLDREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQSSMTTTRTPDTSTMHLATSRTPASLSGPTTASPLLVLFTINCTITNLQYEEDMRRTGSRKFNTMESVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDLRTSGTPSSLSSPTIMXXXPLLXPFTLNFTITNLXYEEXMXXPGSRKFNTTERVLQGLLRPLFKNTSVSSLYSGCRLTLLRPEKDGAATRVDAACTYRPDPKSPGLDREQLYWELSQLTHSITELGPYTLDRVSLYVNGFNPRSSVPTTSTPGTSTVHLATSGTPSSLPGHTAPVPLLIPFTLNFTITNLHYEENMQHPGSRKFNTTERVLQGLLRPLFKSTSVGPLYSGCRLTLLRPEKHGAATGVDAICTLRLDPTGPGLDRERLYWELSQLTNSVTELGPYTLDRDSLYVNGFTQRSSVPTTSIPGTSAVHLETSGTPASLPGHTAPGPLLVPFTLNFTITNLQYEVDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTXXXPLLXPFTLNFTITNLXYEEXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSFLTTSTPWTSTVDLGTSGTPSPVPSPTTAGPLLVPFTLNFTITNLQYEEDMHRPGSRRFNTTERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFSTTERVLQGLLKPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRTSVPTTSTPGTSTVDLGTSGTPFSLPSPAXXXPLLXPFTLNFTITNLXYEEXMXXPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSLPSSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTSLRSEKDGAATGVDAICTHRVDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLIPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETTGTPSSFPGHTEPGPLLIPFTFNFTITNLRYEENMQHPGSRKFNTTERVLQGLLTPLFKNTSVGPLYSGCRLTLLRPEKQEAATGVDTICTHRVDPIGPGLDRERLYWELSQLTNSITELGPYTLDRDSLYVDGFNPWSSVPTTSTPGTSTVHLATSGTPSPLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSITELGPYTLDRDSLYVNGFNPWSSVPTTSTPGTSTVHLATSGTPSSLPGHTTAGPLLVPFTLNFTITNLKYEEDMHCPGSRKFNTTERVLQSLHGPMFKNTSVGPLYSGCRLTLLRSEKDGAATGVDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTNSITELGPYTLDRDSLYVNGFTHRSSMPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFHPRSSVPTTSTPGTSTVHLATSGTPSSLPGHTAPVPLLIPFTLNFTITNLHYEENMQHPGSRKFNTTERVLQGLLGPMFKNTSVGLLYSGCRLTLLRPEKNGAATGMDAICSHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHQNSVPTTSTPGTSTVYWATTGTPSSFPGHTEPGPLLIPFTFNFTITNLHYEENMQHPGSRKFNTTERVLQGLLTPLFKNTSVGPLYSGCRLTLLRPEKQEAATGVDTICTHRVDPIGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRSSVPTTSSPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRTSVPTTSTPGTSTVHLATSGTPSSLPGHTAPVPLLIPFTLNFTITNLQYEEDMHRPGSRKFNTTERVLQGLLSPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWSSGLTTSTPWTSTVDLGTSGTPSPVPSPTTAGPLLVPFTLNFTITNLQYEEDMHRPGSRKFNATERVLQGLLSPIFKNTSVGPLYSGCRLTLLRPEKQEAATGVDTICTHRVDPIGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRSFGLTTSTPWTSTVDLGTSGTPSPVPSPTTAGPLLVPFTLNFTITNLQYEEDMHRPGSRKFNTTERVLQGLLTPLFRNTSVSSLYSGCRLTLLRPEKDGAATRVDAVCTHRPDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWIPVPTSSTPGTSTVDLGSGTPSSLPSPTTAGPLLVPFTLNFTITNLQYGEDMGHPGSRKFNTTERVLQGLLGPIFKNTSVGPLYSGCRLTSLRSEKDGAATGVDAICIHHLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHQTFAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATRVDAVCTHRPDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYNVGFTQRSSVPTTSVPGTPTVDLGTSGTPVSKPGPSAASPLLVLFTLNGTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEY

SEQ ID NO: 147 - DNA, 1422 bp, Homo sapiens
gccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcggaaaaaaaaaaaaaaa

SEQ ID NO: 148 - protein, 439 aa, Homo sapiens
AMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 149 - protein, 1799 aa, Homo sapiens
RTDGIMEHITKIPNEAAHRGTIRPVKGPQTSTSPASPKGLHTGGTKRMETTTTALKTTTTALKTTSRATLTTSVYTPTLGTLTPLNASRQMASTILTEMMITTPYVFPDVPETTSSLATSLGAETSTALPRTTPSVLNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPT

SEQ ID NO: 150 - protein, 156 aa, Homo sapiens
EPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLPKLT

SEQ ID NO: 151 - DNA, 507 bp, Homo sapiens; identical to SEQ ID NO: 67
  CDS (1)..(507)

SEQ ID NO: 152 - protein, 169 aa, Homo sapiens; identical to SEQ ID NO: 68

SEQ ID NO: 153 - DNA, 507 bp, Homo sapiens
aggcagggaggatggagtcccagaggttgccaggtgcactgtggaggtcccaggagtgctggtggttggcacagagctccgagggttgaagccattgacatagagactgtccctgtccagggtgtagggtcccagctctgtgatgctgttggtcagctggctcagctcccagtatagccgctctctgtccagtccaggtccgatgggatcaacgcggtgggtacagatggtgtccactccagtggctgcctcatgcttctcaggtctgagcaaggtcagtctgcagccagagtacagagggccaacactggtgttcttgaacaagggcttgagcagaccctgcagaaccctctccgtggtgttgaacttcctggaaccagggtgttgcatgttttcctcataatgcaggttggtgatggtaaagttgaaagtgaatggtatcaggagagggccaggctctgtgtggcccatggatccgtgatggtgatggtgatgcgatcctctcat

SEQ ID NO: 154 - protein, 9 aa, Homo sapiens
RLYWELSQL

SEQ ID NO: 155 - protein, 9 aa, Homo sapiens
TLDRDSLYV

SEQ ID NO: 156 - protein, 9 aa, Homo sapiens
VLQGLLKPL

SEQ ID NO: 157 - protein, 9 aa, Homo sapiens
QLTNSITEL

SEQ ID NO: 158 - protein, 780 aa, Homo sapiens
ATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTAAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREQLYWELSQLTNGIKELGPYTLDRNSLYVNGFTHWIPVPTSSTPGTSTVDLGSGTPSSLPSPTAAGPLLVPFTLNFTITNLQYEEDMHHPGSRKFNTTERVLQGLLGPMFKNTSVGLLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPT

SEQ ID NO: 159 - protein, 780 aa, Homo sapiens
SAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLPGHT

SEQ ID NO: 160 - protein, 624 aa, Homo sapiens
TAGPLLVPFTLNFTITNLQYEEDMHRPGSRRFNTTERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFSTTERVLQGLLKPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLPGHT

SEQ ID NO: 161 - protein, 468 aa, Homo sapiens
ATGPVLLPFTLNFTITNLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYNVGFTQRSSVPTTSVPGTPTVDLGTSGTPVSKPGPSAASPLLVLFTLNGTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPS

SEQ ID NO: 162 - protein, 11721 aa, Homo sapiens
  MISC_FEATURE (1)..(11721): Any "X" = any amino acid
MEHITKIPNEAAHRGTIRPVKGPQTSTSPASPKGLHTGGTKRMETTTTALKTTTTALKTTSRATLTTSVYTPTLGTLTPLNASRQMASTILTEMMITTPYVFPDVPETTSSLATSLGAETSTALPRTTPSVLNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTAAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREQLYWELSQLTNGIKELGPYTLDRNSLYVNGFTHWIPVPTSSTPGTSTVDLGSGTPSSLPSPTAAGPLLVPFTLNFTITNLQYEEDMHHPGSRKFNTTERVLQGLLGPMFKNTSVGLLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMRHPGSRKFNTTERVLQGLLKPLFKSTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLPGHTAPVPLLIPFTLNFTITNLHYEENMQHPGSRKFNTTERVLQGLLKPLFKNTSVGPLYSGCRLTLLRPEKHEAATGVDTICTHRVDPIGPGLDREXLYWELSXLTXXIXELGPYXLDRXSLYVNGFXXXXXXXXTSTPGTSXVXLXTSGTPXXXPXXTSAGPLLVPFTLNFTITNLQYEEDMHHPGSRKFNTTERVLQGLLGPMFKNTSVGLLYSGCRLTLLRPEKNGAATGMDAICSHRLDPKSPGLDREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQSSMTTTRTPDTSTMHLATSRTPASLSGPTTASPLLVLFTINCTITNLQYEEDMRRTGSRKFNTMESVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDLRTSGTPSSLSSPTIMXXXPLLXPFTLNFTITNLXYEEXMXXPGSRKFNTTERVLQGLLRPLFKNTSVSSLYSGCRLTLLRPEKDGAATRVDAACTYRPDPKSPGLDREQLYWELSQLTHSITELGPYTLDRVSLYVNGFNPRSSVPTTSTPGTSTVHLATSGTPSSLPGHTXXXPLLXPFTLNFTITNLXYEEXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSFLTTSTPWTSTVDLGTSGTPSPVPSPTTAGPLLVPFTLNFTITNLQYEEDMHRPGSRRFNTTERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFSTTERVLQGLLKPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRTSVPTTSTPGTSTVDLGTSGTPFSLPSPAXXXPLLXPFTLNFTITNLXYEEXMXXPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSLPSSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTSLRSEKDGAATGVDAICTHRVDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLIPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETTGTPSSFPGHTEPGPLLIPFTFNFTITNLRYEENMQHPGSRKFNTTERVLQGLLTPLFKNTSVGPLYSGCRLTLLRPEKQEAATGVDTICTHRVDPIGPGLDRERLYWELSQLTNSITELGPYTLDRDSLYVDGFNPWSSVPTTSTPGTSTVHLATSGTPSPLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSITELGPYTLDRDSLYVNGFNPWSSVPTTSTPGTSTVHLATSGTPSSLPGHTTAGPLLVPFTLNFTITNLKYEEDMHCPGSRKFNTTERVLQSLHGPMFKNTSVGPLYSGCRLTLLRSEKDGAATGVDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTNSITELGPYTLDRDSLYVNGFTHRSSMPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFHPRSSVPTTSTPGTSTVHLATSGTPSSLPGHTAPVPLLIPFTLNFTITNLHYEENMQHPGSRKFNTTERVLQGLLGPMFKNTSVGLLYSGCRLTLLRPEKNGAATGMDAICSHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHQNSVPTTSTPGTSTVYWATTGTPSSFPGHTEPGPLLIPFTFNFTITNLHYEENMQHPGSRKFNTTERVLQGLLTPLFKNTSVGPLYSGCRLTLLRPEKQEAATGVDTICTHRVDPIGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRSSVPTTSSPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRTSVPTTSTPGTSTVHLATSGTPSSLPGHTAPVPLLIPFTLNFTITNLQYEEDMHRPGSRKFNTTERVLQGLLSPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWSSGLTTSTPWTSTVDLGTSGTPSPVPSPTTAGPLLVPFTLNFTITNLQYEEDMHRPGSRKFNATERVLQGLLSPIFKNTSVGPLYSGCRLTLLRPEKQEAATGVDTICTHRVDPIGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRSFGLTTSTPWTSTVDLGTSGTPSPVPSPTTAGPLLVPFTLNFTITNLQYEEDMHRPGSRKFNTTERVLQGLLTPLFRNTSVSSLYSGCRLTLLRPEKDGAATRVDAVCTHRPDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWIPVPTSSTPGTSTVDLGSGTPSSLPSPTTAGPLLVPFTLNFTITNLQYGEDMGHPGSRKFNTTERVLQGLLGPIFKNTSVGPLYSGCRLTSLRSEKDGAATGVDAICIHHLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHQTFAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATRVDAVCTHRPDPKSPGLDREXLYWELSXLTXXIXELGPYXLDRXSLYVNGFXXXXXXXXTSTPGTSXVXLXTSGTPXXXPXXTAPVPLLIPFTLNFTITNLHYEENMQHPGSRKFNTTERVLQGLLRPLFKSTSVGPLYSGCRLTLLRPEKHGAATGVDAICTLRLDPTGPGLDRERLYWELSQLTNSVTELGPYTLDRDSLYVNGFTQRSSVPTTSIPGTSAVHLETSGTPASLPGHTAPGPLLVPFTLNFTITNLQYEVDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTXXXPLLXPFTLNFTITNLXYEEXMXXPGSRKFNTTERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYNVGFTQRSSVPTTSVPGTPTVDLGTSGTPVSKPGPSAASPLLVLFTLNGTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 163 - protein, 156 aa, Homo sapiens
TAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHT

SEQ ID NO: 164 - protein, 42 aa, Homo sapiens
ATVPFMVPFTLNFTITNLQYEEDMRHPGSRKFNATERELQGL

SEQ ID NO: 165 - protein, 42 aa, Homo sapiens
TAVPLLVPFTLNFTITNLQYGEDMRHPGSRKFNTTERVLQGL

SEQ ID NO: 166 - protein, 42 aa, Homo sapiens
VPGPLLVPFTLNFTITNLQYEEAMRHPGSRKFNTTERVLQGL

SEQ ID NO: 167 - protein, 42 aa, Homo sapiens
APGPLLVPFTLNFTITNLQYEEDMRHPGSRKFSTTERVLQGL

SEQ ID NO: 168 - protein, 42 aa, Homo sapiens
APGPLLVPFTLNFTITNLQYEEDMRHPGSRKFNTTERVLQGL

SEQ ID NO: 169 - protein, 42 aa, Homo sapiens
APGPLLVPFTLNFTITNLQYEVDMRHPGSRKFNTTERVLQGL

SEQ ID NO: 170 - protein, 42 aa, Homo sapiens
SAGPLLVPFTLNFTITNLQYEEDMRHPGSRKFNTTERVLQGL

SEQ ID NO: 171 - protein, 42 aa, Homo sapiens
AAGPLLMPFTLNFTITNLQYEEDMRRTGSRKFNTMESVLQGL

SEQ ID NO: 172 - protein, 42 aa, Homo sapiens
TASPLLVLFTINCTITNLQYEEDMRRTGSRKFNTMESVLQGL

SEQ ID NO: 173 - protein, 42 aa, Homo sapiens
AAGPLLVPFTLNFTITNLQYGEDMGHPGSRKFNTTERVLQGL

SEQ ID NO: 174 - protein, 42 aa, Homo sapiens
TAGPLLIPFTLNFTITNLQYGEDMGHPGSRKFNTTERVLQGL

SEQ ID NO: 175 - protein, 42 aa, Homo sapiens
TAGPLLVPFTLNFTITNLQYGEDMGHPGSRKFNTTERVLQGL

SEQ ID NO: 176 - protein, 42 aa, Homo sapiens
TAGPLLVLFTLNFTITNLKYEEDMHRPGSRKFNTTERVLQTL

SEQ ID NO: 177 - protein, 42 aa, Homo sapiens
TAGPLLVPFTLNFTITNLQYEEDMHRPGSRKFNATERVLQGL

SEQ ID NO: 178 - protein, 42 aa, Homo sapiens
TAGPLLVPFTLNFTITNLQYEEDMHRPGSRRFNTTERVLQGL

SEQ ID NO: 179 - protein, 42 aa, Homo sapiens
TAGPLLVPFTLNFTITNLQYEEDMHRPGSRKFNTTERVLQGL

SEQ ID NO: 180 - protein, 42 aa, Homo sapiens
APVPLLIPFTLNFTITNLQYEEDMHRPGSRKFNTTERVLQGL

SEQ ID NO: 181 - protein, 42 aa, Homo sapiens
ATGPVLLPFTLNFTITNLQYEEDMHRPGSRKFNTTERVLQGL

SEQ ID NO: 182 - protein, 42 aa, Homo sapiens
AAGPLLVPFTLNFTITNLQYEEDMHHPGSRKFNTTERVLQGL

SEQ ID NO: 183 - protein, 42 aa, Homo sapiens
SAGPLLVPFTLNFTITNLQYEEDMHHPGSRKFNTTERVLQGL

SEQ ID NO: 184 - protein, 42 aa, Homo sapiens
TASPLLVLFTINFTITNQRYEENMHHPGSRKFNTTERVLQGL

SEQ ID NO: 185 - protein, 42 aa, Homo sapiens
TASPLLVLFTINFTITNLRYEENMHHPGSRKFNTTERVLQGL

SEQ ID NO: 186 - protein, 42 aa, Homo sapiens
EPGPLLIPFTFNFTITNLHYEENMQHPGSRKFNTTERVLQGL

SEQ ID NO: 187 - protein, 42 aa, Homo sapiens
EPGPLLIPFTFNFTITNLRYEENMQHPGSRKFNTTERVLQGL

SEQ ID NO: 188 - protein, 42 aa, Homo sapiens
APVPLLIPFTLNFTITNLHYEENMQHPGSRKFNTTERVLQGL

SEQ ID NO: 189 - protein, 42 aa, Homo sapiens
APVPLLIPFTLNFTITDLHYEENMQHPGSRKFNTTERVLQGL

SEQ ID NO: 190 - protein, 42 aa, Homo sapiens
AASPLLVLFTLNGTITNLRYEENMQHPGSRKFNTTERVLQGL

SEQ ID NO: 191 - protein, 42 aa, Homo sapiens
TAGPLLVPFTLNFTITNLKYEEDMHCPGSRKFNTTERVLQSL

SEQ ID NO: 192 - protein, 41 aa, Homo sapiens
AASHLLILFTLNFTITNLRYEENMWPGSRKFNTTERVLQGL

SEQ ID NO: 193 - protein, 42 aa, Homo sapiens
TGVVSEEPFTLNFTINNLRYMADMGQPGSLKFNITDNVMKHL

SEQ ID NO: 194 - protein, 42 aa, Homo sapiens
AMGYHLKTLTLNFTISNLQYSPDMGKGSATFNSTEGVLQHLL

SEQ ID NO: 195 - protein, 23 aa, Homo sapiens
LKPLFRNSSLEYLYSGCRLASLR

SEQ ID NO: 196 - protein, 23 aa, Homo sapiens
LKPLFKNTSVSSLYSGCRLTLLR

SEQ ID NO: 197 - protein, 23 aa, Homo sapiens
LKPLFKNTSVGPLYSGCRLTLLR

SEQ ID NO: 198 - protein, 23 aa, Homo sapiens
LKPLFKSTSVGPLYSGCRLTLLR

SEQ ID NO: 199 - protein, 23 aa, Homo sapiens
LKPLFKSTSVGPLYSSCRLTLLR

SEQ ID NO: 200 - protein, 23 aa, Homo sapiens
LKPLFKNTSVGPLYSGCRLTSLR

SEQ ID NO: 201 - protein, 23 aa, Homo sapiens
LGPIFKNTSVGPLYSGCRLTSLR

SEQ ID NO: 202 - protein, 23 aa, Homo sapiens
LGPMFKNTSVGLLYSGCRLTLLR

SEQ ID NO: 203 - protein, 23 aa, Homo sapiens
LGPMFKNTSVGPLYSGCRLTLLR

SEQ ID NO: 204 - protein, 23 aa, Homo sapiens
LGPMFKNTSVGPLYSGCRLTSLR

SEQ ID NO: 205 - protein, 23 aa, Homo sapiens
LGPLFKNSSVGPLYSGCRLISLR

SEQ ID NO: 206 - protein, 23 aa, Homo sapiens
LGPLFKNSSVDPLYSGCRLTSLR

SEQ ID NO: 207 - protein, 23 aa, Homo sapiens
LSPIFKNSSVGPLYSGCRLTSLR

SEQ ID NO: 208 - protein, 23 aa, Homo sapiens
LSPIFKNTSVGPLYSGCRLTLLR

SEQ ID NO: 209 - protein, 23 aa, Homo sapiens
LSPLFQRSSLGARYTGCRVIALR

SEQ ID NO: 210 - protein, 23 aa, Homo sapiens
LRPLFKNTSVSSLYSGCRLTLLR

SEQ ID NO: 211 - protein, 23 aa, Homo sapiens
LRPLFKNTSVGPLYSGSRLTLLR

SEQ ID NO: 212 - protein, 23 aa, Homo sapiens
LRPLFKNTSIGPLYSSCRLTLLR

SEQ ID NO: 213 - protein, 23 aa, Homo sapiens
LRPLFKSTSVGPLYSGCRLTLLR

SEQ ID NO: 214 - protein, 23 aa, Homo sapiens
LRPVFKNTSVGLLYSGCRLTLLR

SEQ ID NO: 215 - protein, 23 aa, Homo sapiens
LRPVFKNTSVGPLYSGCRLTLLR

SEQ ID NO: 216 - protein, 23 aa, Homo sapiens
LRSLFKSTSVGPLYSGCRLTLLR

SEQ ID NO: 217 - protein, 23 aa, Homo sapiens
LRSLFKSTSVGPLYSGCRLTSLR

SEQ ID NO: 218 - protein, 23 aa, Homo sapiens
LTPLFKNTSVGPLYSGCRLTLLR

SEQ ID NO: 219 - protein, 23 aa, Homo sapiens
LTPLFRNTSVSSLYSGCRLTLLR

SEQ ID NO: 220 - protein, 23 aa, Homo sapiens
LMPLFKNTSVSSLYSGCRLTLLR

SEQ ID NO: 221 - protein, 22 aa, Homo sapiens
RPLFQKSSMGPFYLGCQLISLR

SEQ ID NO: 222 - protein, 58 aa, Homo sapiens
PEKDSSAMAVDAICTHRPDPEDLGLDRERLYWELSNLTNGIQELGPYTLDRNSLYVNG

SEQ ID NO: 223 - protein, 58 aa, Homo sapiens
PEKDGAATGVDAICTHRLDPKSPGLNREQLYWELSKLTNDIEELGPYTLDRNSLYVNG

SEQ ID NO: 224 - protein, 58 aa, Homo sapiens
PKKDGAATGVDAICTHRLDPKSPGLNREQLYWELSKLTNDIEELGPYTLDRNSLYVNG

SEQ ID NO: 225 - protein, 58 aa, Homo sapiens
PEKDGTATGVDAICTHHPDPKSPRLDREQLYWELSQLTHNITELGHYALDNDSLFVNG

SEQ ID NO: 226 - protein, 58 aa, Homo sapiens
PEKDGEATGVDAICTHRPDPTGPGLDREQLYLELSQLTHSITELGPYTLDRDSLYVNG

SEQ ID NO: 227 - protein, 58 aa, Homo sapiens
PEKDGAATGMDAVCLYHPNPKRPGLDREQLYWELSQLTHNITELGPYSLDRDSLYVNG

SEQ ID NO: 228 - protein, 58 aa, Homo sapiens
PEKDGAATGMDAVCLYHPNPKRPGLDREQLYCELSQLTHNITELGPYSLDRDSLYVNG

SEQ ID NO: 229 - protein, 58 aa, Homo sapiens
PEKDGAATRVDAACTYRPDPKSPGLDREQLYWELSQLTHSITELGPYTLDRVSLYVNG

SEQ ID NO: 230 - protein, 58 aa, Homo sapiens
PKKDGAATKVDAICTYRPDPKSPGLDREQLYWELSQLTHSITELGPYTQDRDSLYVNG

SEQ ID NO: 231 - protein, 58 aa, Homo sapiens
PKKDGAATKVDAICTYRPDPKSPGLDREQLYWELSQLTHSITELGPYTQDRDSLYNVG

SEQ ID NO: 232 - protein, 58 aa, Homo sapiens
PEKDGAATRVDAVCTHRPDPKSPGLDRERLYWKLSQLTHGITELGPYTLDRHSLYVNG

SEQ ID NO: 233 - protein, 58 aa, Homo sapiens
PEKDGVATRVDAICTHRPDPKIPGLDRQQLYWELSQLTHSITELGPYTLDRDSLYVNG

SEQ ID NO: 234 - protein, 58 aa, Homo sapiens
SEKDGAATGVDAICIHHLDPKSPGLNRERLYWELSQLTNGIKELGPYTLDRNSLYVNG

SEQ ID NO: 235 - protein, 58 aa, Homo sapiens
SEKDGAATGVDAICTHRLDPKSPGLDREQLYWELSQLTNGIKELGPYTLDRNSLYVNG

SEQ ID NO: 236 - protein, 58 aa, Homo sapiens
SEKDGAATGVDAICTHRLDPKSPGVDREQLYWELSQLTNGIKELGPYTLDRNSLYVNG

SEQ ID NO: 237 - protein, 58 aa, Homo sapiens
SEKDGAATGVDAICTHRVDPKSPGVDREQLYWELSQLTNGIKELGPYTLDRNSLYVNG

SEQ ID NO: 238 - protein, 58 aa, Homo sapiens
SEKDGAATGVDAICTHHLNPQSPGLDREQLYWQLSQMTNGIKELGPYTLDRNSLYVNG

SEQ ID NO: 239 - protein, 58 aa, Homo sapiens
PEKRGAATGVDTICTHRLDPLNPGLDREQLYWELSKLTRGIIELGPYLLDRGSLYVNG

SEQ ID NO: 240 - protein, 58 aa, Homo sapiens
PEKNGAATGMDAICSHRLDPKSPGLNREQLYWELSQLTHGIKELGPYTLDRNSLYVNG

SEQ ID NO: 241 - protein, 58 aa, Homo sapiens
PEKNGAATGMDAICSHRLDPKSPGLDREQLYWELSQLTHGIKELGPYTLDRNSLYVNG

SEQ ID NO: 242 - protein, 58 aa, Homo sapiens
PEKHGAATGVDAICTLRLDPTGPGLDRERLYWELSQLTNSVTELGPYTLDRDSLYVNG

SEQ ID NO: 243 - protein, 58 aa, Homo sapiens
PEKHGAATGVDAICTLRLDPTGPGLDRERLYWELSQLTNSITELGPYTLDRDSLYVNG

SEQ ID NO: 244 - protein, 58 aa, Homo sapiens
PEKHEAATGVDTICTHRVDPIGPGLDRERLYWELSQLTNSITELGPYTLDRDSLYVNG

SEQ ID NO: 245 - protein, 58 aa, Homo sapiens
PEKQEAATGVDTICTHRVDPIGPGLDRERLYWELSQLTNSITELGPYTLDRDSLYVNG

SEQ ID NO: 246 - protein, 58 aa, Homo sapiens
PEKQEAATGVDTICTHRVDPIGPGLDRERLYWELSQLTNSITELGPYTLDRDSLYVDG

SEQ ID NO: 247 - protein, 58 aa, Homo sapiens
PEKDKAATRVDAICTHHPDPQSPGLNREQLYWELSQLTHGITELGPYTLDRDSLYVDG

SEQ ID NO: 248 - protein, 58 aa, Homo sapiens
SVKNGAETRVDLLCTYLQPLSGPGLPIKQVFHELSQQTHGITRLGPYSLDKDSLYLNG

SEQ ID NO: 249 - protein, 58 aa, Homo sapiens
PEKDGAATGVDTTCTYHPDPVGPGLDIQQLYWELSQLTHGVTQLGFYVLDRDSLFING

SEQ ID NO: 250 - protein, 12 aa, Homo sapiens
FTHRSSMPTTST

SEQ ID NO: 251 - protein, 12 aa, Homo sapiens
FTHRSSMPTTSI

SEQ ID NO: 252 - protein, 12 aa, Homo sapiens
FTHRTSVPTSST

SEQ ID NO: 253 - protein, 12 aa, Homo sapiens
FTHRTSVPTTST

SEQ ID NO: 254 - protein, 12 aa, Homo sapiens
FTHRSSVPTTSS

SEQ ID NO: 255 - protein, 12 aa, Homo sapiens
FTHRSSVSTTST

SEQ ID NO: 256 - protein, 12 aa, Homo sapiens
FTHRSSVAPTST

SEQ ID NO: 257 - protein, 12 aa, Homo sapiens
FTHRSSGLTTST

SEQ ID NO: 258 - protein, 12 aa, Homo sapiens
FTHRSFGLTTST

SEQ ID NO: 259 - protein, 12 aa, Homo sapiens
FTHRSSFLTTST

SEQ ID NO: 260 - protein, 12 aa, Homo sapiens
FTHRNFVPITST

SEQ ID NO: 261 - protein, 12 aa, Homo sapiens
FTHRSSVPTTSI

SEQ ID NO: 262 - protein, 12 aa, Homo sapiens
FTHQSSVSTTST

SEQ ID NO: 263 - protein, 12 aa, Homo sapiens
FTHQTSAPNTST

SEQ ID NO: 264 - protein, 12 aa, Homo sapiens
FTHQTFAPNTST

SEQ ID NO: 265 - protein, 12 aa, Homo sapiens
FTHQNSVPTTST

SEQ ID NO: 266 - protein, 12 aa, Homo sapiens
FTHQSSMTTTRT

SEQ ID NO: 267 - protein, 12 aa, Homo sapiens
FTHWIPVPTSST

SEQ ID NO: 268 - protein, 12 aa, Homo sapiens
FTHWSPIPTTST

SEQ ID NO: 269 - protein, 12 aa, Homo sapiens
FTHWSSGLTTST

SEQ ID NO: 270 - protein, 12 aa, Homo sapiens
FHPRSSVPTTST

SEQ ID NO: 271 - protein, 12 aa, Homo sapiens
FNPRSSVPTTST

SEQ ID NO: 272 - protein, 12 aa, Homo sapiens
FNPWSSVPTTST

SEQ ID NO: 273 - protein, 12 aa, Homo sapiens
FTQRSSVPTTSI

SEQ ID NO: 274 - protein, 12 aa, Homo sapiens
FTQRSSVPTTST

SEQ ID NO: 275 - protein, 12 aa, Homo sapiens
FTQRSSVPTTSV

SEQ ID NO: 276 - protein, 12 aa, Homo sapiens
YNEPGLDEPPTT

SEQ ID NO: 277 - protein, 12 aa, Homo sapiens
YAPQNLSIRGEY

SEQ ID NO: 278 - protein, 21 aa, Homo sapiens
PGTSTVDVGTSGTPSSSPSPT

SEQ ID NO: 279 - protein, 23 aa, Homo sapiens
PGTSTVDLRTSGTPSSLSSPTIM

SEQ ID NO: 280 - protein, 21 aa, Homo sapiens
PGTSTVDLGTSGTPFSLPSPA

SEQ ID NO: 281 - protein, 20 aa, Homo sapiens
PGTSTVDLGSGTPSSLPSPT

SEQ ID NO: 282 - protein, 20 aa, Homo sapiens
PGTSTVDLGSGTPSLPSSPT

SEQ ID NO: 283 - protein, 21 aa, Homo sapiens
PGTSTVDLGTSGTPSSLPSPT

SEQ ID NO: 284 - protein, 21 aa, Homo sapiens
PGTPTVDLGTSGTPVSKPGPS

SEQ ID NO: 285 - protein, 21 aa, Homo sapiens
PWTSTVDLGTSGTPSPVPSPT

SEQ ID NO: 286 - protein, 21 aa, Homo sapiens
PGTSTVYWATTGTPSSFPGHT

SEQ ID NO: 287 - protein, 21 aa, Homo sapiens
PGTSTVHLATSGTPSSLPGHT

SEQ ID NO: 288 - protein, 21 aa, Homo sapiens
PGTSTVHLATSGTPSPLPGHT

SEQ ID NO: 289 - protein, 21 aa, Homo sapiens
PDTSTMHLATSRTPASLSGPT

SEQ ID NO: 290 - protein, 21 aa, Homo sapiens
PGTSAVHLETSGTPASLPGHT

SEQ ID NO: 291 - protein, 21 aa, Homo sapiens
PGTSAVHLETTGTPSSFPGHT

SEQ ID NO: 292 - protein, 21 aa, Homo sapiens
PGTSTVHLGTSETPSSLPRPI

SEQ ID NO: 293 - protein, 21 aa, Homo sapiens
PGTSIVNLGTSGIPPSLPETT

SEQ ID NO: 294 - protein, 21 aa, Homo sapiens
PGTFTVQPETSETPSSLPGPT

SEQ ID NO: 295 - protein, 21 aa, Homo sapiens
PGTPTVDLGTSGTPVSKPGPS

SEQ ID NO: 296 - protein, 21 aa, Homo sapiens
PGTPTVYLGASKTPASIFGPS

SEQ ID NO: 297 - protein, 16 aa, Homo sapiens
PKPATTFLPPLSEATT

SEQ ID NO: 298 - protein, 21 aa, Homo sapiens
QINFHIVNWNLSNPDPTSSEY

SEQ ID NO: 299 - protein, 1794 aa, Homo sapiens
MEHITKIPNEAAHRGTIRPVKGPQTSTSPASPKGLHTGGTKRMETTTTALKTTTTALKTTSRATLTTSVYTPTLGTLTPLNASRQMASTILTEMMITTPYVFPDVPETTSSLATSLGAETSTALPRTTPSVLNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPT

SEQ ID NO: 300 - protein, 284 aa, Homo sapiens
ITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 301 - DNA, 24 bp, Artificial Sequence
  Synthetic primer
gtctctatgtcaatggtttcaccc

SEQ ID NO: 302 - DNA, 21 bp, Artificial Sequence
  Synthetic primer
tagctgctctctgtccagtcc

SEQ ID NO: 303 - DNA, 22 bp, Artificial Sequence
  Synthetic primer
ggacaaggtcaccacactctac

SEQ ID NO: 304 - DNA, 24 bp, Artificial Sequence
  Synthetic primer
gcagatcctccaggtctaggtgtg

SEQ ID NO: 305 - DNA, 24 bp, Artificial Sequence
  Synthetic primer
gtctctatgtcaatggtttcaccc

SEQ ID NO: 306 - DNA, 21 bp, Artificial Sequence
  Synthetic primer
tagctgctctctgtccagtcc

SEQ ID NO: 307 - DNA, 468 bp, Homo sapiens
actgctggccctctcctggtgccattcaccctcaacttcaccatcaccaacctgcagtatgaggaggacatgcatcgccctggatctaggaagttcaacaccacagagagggtcctgcagggtctgcttagtcccatattcaagaacaccagtgttggccctctgtactctggctgcagactgacctctctcaggtctgagaaggatggagcagccactggagtggatgccatctgcatccatcatcttgaccccaaaagccctggactcaacagagagcggctgtactgggagctgagccgactgaccaatggcatcaaagagctgggcccctacaccctggacaggaacagtctctatgtcaatggtttcacccatcggacctctgtgcccaccaccagcactcctgggacctccacagtggaccttggaacctcagggactccattctccctcccaagccccgca

SEQ ID NO: 308 - protein, 156 aa, Homo sapiens
TAGPLLVPFTLNFTITNLQYEEDMHRPGSRKFNTTERVLQGLLSPIFKNTSVGPLYSGCRLTSLRSEKDGAATGVDAICIHHLDPKSPGLNRERLYWELSRLTNGIKELGPYTLDRNSLYVNGFTHRTSVPTTSTPGTSTVDLGTSGTPFSLPSPA

SEQ ID NO: 309 - DNA, 31497 bp, Homo sapiens
  CDS (205)..(31497)
aagcgttgcacaattcccccaacctccatacatacggcagctcttctagacacaggttttcccaggtcaaatgcggggaccccagccatatctcccaccctgagaaattttggagtttcagggagctcagaagctctgcagaggccaccctctctgaggggattcttcttagacctccatccagaggcaaatgttgacctgtccatgctgaaaccctcaggccttcctgggtcatcttctcccacccgctccttgatgacagggagcaggagcactaaagccacaccagaaatggattcaggactgacaggagccaccttgtcacctaagacatctacaggtgcaatcgtggtgacagaacatactctgccctttacttccccagataagaccttggccagtcctacatcttcggttgtgggaagaaccacccagtctttgggggtgatgtcctctgctctccctgagtcaacctctagaggaatgacacactccgagcaaagaaccagcccatcgctgagtccccaggtcaatggaactccctctaggaactaccctgctacaagcatggtttcaggattgagttccccaaggaccaggaccagttccacagaaggaaattttaccaaagaagcatctacatacacactcactgtagagaccacaagtggcccagtcactgagaagtacacagtccccactgagacctcaacaactgaaggtgacagcacagagaccccctgggacacaagatatattcctgtaaaaatcacatctccaatgaaaacatttgcagattcaactgcatccaaggaaaatgccccagtgtctatgactccagctgagaccacagttactgactcacatactccaggaaggacaaacccatcatttgggacactttattcttccttccttgacctatcacctaaagggaccccaaattccagaggtgaaacaagcctggaactgattctatcaaccactggatatcccttctcctctcctgaacctggctctgcaggacacagcagaataagtaccagtgcgcctttgtcatcatctgcttcagttctcgataataaaatatcagagaccagcatattctcaggccagagtctcacctcccctctgtctcctggggtgcccgaggccagagccagcacaatgcccaactcagctatccctttttccatgacactaagcaatgcagaaacaagtgccgaaagggtcagaagcacaatttcctctctggggactccatcaatatccacaaagcagacagcagagactatccttaccttccatgccttcgctgagaccatggatatacccagcacccacatagccaagactttggcttcagaatggttgggaagtccaggtacccttggtggcaccagcacttcagcgctgacaaccacatctccatctaccactttagtctcagaggagaccaacacccatcactccacgagtggaaaggaaacagaaggaactttgaatacatctatgactccacttgagacctctgctcctggagaagagtccgaaatgactgccaccttggtccccactctaggttttacaactcttgacagcaagatcagaagtccatctcaggtctcttcatcccacccaacaagagagctcagaaccacaggcagcacctctgggaggcagagttccagcacagctgcccacgggagctctgacatcctgagggcaaccacttccagcacctcaaaagcatcatcatggaccagtgaaagcacagctcagcaatttagtgaaccccagcacacacagtgggtggagacaagtcctagcatgaaaacagagagacccccagcatcaaccagtgtggcagcccctatcaccacttctgttccctcagtggtctctggcttcaccaccctgaagaccagctccacaaaagggatttggcttgaagaaacatctgcagacacactcatcggagaatccacagctggcccaaccacccatcagtttgctgttcccactgggatttcaatgacaggaggcagcagcaccaggggaagccagggcacaacccacctactcaccagagccacagcatcatctgagacatccgcagatttgactctggccacgaacggtgtcccagtctccgtgtctccagcagtgagcaagacggctgctggctcaagtcctccaggagggacaaagccatcatatacaatggtttcttctgtcatccctgagacatcatctctacagtcctcagctttcagggaaggaaccagcctgggactgactccattaaacactagacatcccttctcttcccctgaaccagactctgcaggacacaccaagataagcaccagcattcctctgttgtcatctgcttcagttcttgaggataaagtgtcagcgaccagcacattctcacaccacaaagccacctcatctattaccacagggactcctgaaatctcaacaaagacaaagcccagctcagccgttctttcctccatgaccctaagcaatgcagcaacaagtcctgaaagagtcagaaatgcaacttcccctctgactcatccatctccatcaggggaagagacagcagggagtgtcctcactctcagcacctctgctgagactacagactcacctaacatccacccaactgggacactgacttcagaatcgtcagagagtcctagcactctcagcctcccaagtgtctctggagtcaaaaccacattttcttcatctactccttccactcatctatttactagtggagaagaaacagaggaaacttcgaatccatctgtgtctcaacctgagacttctgtttccagagtaaggaccaccttggccagcacctctgtccctaccccagtattccccaccatggacacctggcctacacgttcagctcagttctcttcatcccacctagtgagtgagctcagagctacgagcagtacctcagttacaaactcaactggttcagctcttcctaaaatatctcacctcactgggacggcaacaatgtcacagaccaatagagacacgtttaatgactctgctgcaccccaaagcacaacttggccagagactagtcccagattcaagacagggttaccttcagcaacaaccactgtttcaacctctgccacttctctctctgctactgtaatggtctctaaattcacttctccagcaactagttccatggaagcaacttctatcagggaaccatcaacaaccatcctcacaacagagaccacgaatggcccaggctctatggctgtggcttctaccaacatcccaattggaaagggctacattactgaaggaagattggacacaagccatctgcccattggaaccacagcttcctctgagacatctatggattttaccatggccaaagaaagtgtctcaatgtcagtatctccatctcagtccatggatgctgctggctcaagcactccaggaaggacaagccaattcgttgacacattttctgatgatgtctatcatttaacatccagagaaattacaatacctagagatggaacaagctcagctctgactccacaaatgactgcaactcaccctccatctcctgatcctggctctgctagaagcacctggcttggcatcttgtcctcatctccttcttctcctactcccaaagtcacaatgagctccacattttcaactcagagagtcaccacaagcatgataatggacacagttgaaactagtcggtggaacatgcccaacttaccttccacgacttccctgacaccaagtaatattccaacaagtggtgccataggaaaaagcaccctggttcccttggacactccatctccagccacatcattggaggcatcagaagggggacttccaaccctcagcacctaccctgaatcaacaaacacacccagcatccacctcggagcacacgctagttcagaaagtccaagcaccatcaaacttaccatggcttcagtagtaaaacctggctcttacacacctctcaccttcccctcaatagagacccacattcatgtatcaacagccagaatggcttactcttctgggtcttcacctgagatgacagctcctggagagactaacactggtagtacctgggaccccaccacctacatcaccactacggatcctaaggatacaagttcagctcaggtctctacaccccactcagtgaggacactcagaaccacagaaaaccatccaaagacagagtccgccaccccagctgcttactctggaagtcctaaaatctcaagttcacccaatctcaccagtccggccacaaaagcatggaccatcacagacacaactgaacactccactcaattacattacacaaaattggcagaaaaatcatctggatttgagacacagtcagctccaggacctgtctctgtagtaatccctacctcccctaccattggaagcagcacattggaactaacttctgatgtcccaggggaacccctggtccttgctcccagtgagcagaccacaatcactctccccatggcaacatggctgagtaccagtttgacagaggaaatggcttcaacagaccttgatatttcaagtccaagttcacccatgagtacatttgctatttttccacctatgtccacaccttctcatgaactttcaaagtcagaggcagataccagtgccattagaaatacagattcaacaacgttggatcagcacctaggaatcaggagtttgggcagaactggggacttaacaactgttcctatcaccccactgacaaccacgtggaccagtgtgattgaacactcaacacaagcacaggacaccctttctgcaacgatgagtcctactcacgtgacacagtcactcaaagatcaaacatctataccagcctcagcatccccttcccatcttactgaagtctaccctgagctcgggacacaagggagaagctcctctgaggcaaccactttttggaaaccatctacagacacactgtccagagagattgagactggcccaacaaacattcaatccactccacccatggacaacacaacaacagggagcagtagtagtggagtcaccctgggcatagcccaccttcccataggaacatcctccccagctgagacatccacaaacatggcactggaaagaagaagttctacagccactgtctctatggctgggacaatgggactccttgttactagtgctccaggaagaagcatcagccagtcattaggaagagtttcctctgtcctttctgagtcaactactgaaggagtcacagattctagtaagggaagcagcccaaggctgaacacacagggaaatacagctctctcctcctctcttgaacccagctatgctgaaggaagccagatgagcacaagcatccctctaacctcatctcctacaactcctgatgtggaattcatagggggcagcacattttggaccaaggaggtcaccacagttatgacctcagacatctccaagtcttcagcaaggacagagtccagctcagctacccttatgtccacagctttgggaagcactgaaaatacaggaaaagaaaaactcagaactgcctctatggatcttccatctccaactccatcaatggaggtgacaccatggatttctctcactctcagtaatgcccccaataccacagattcacttgacctcagccatggggtgcacaccagctctgcagggactttggccactgacaggtcattgaatactggtgtcactagagcctccagattggaaaacggctctgatacctcttctaagtccctgtctatgggaaacagcactcacacttccatgactgacacagagaagagtgaagtgtcttcttcaatccatccccgacctgagacctcagctcctggagcagagaccactttgacttccactcctggaaacagggccataagcttaacattgcctttttcatccattccagtggaagaagtcatttctacaggcataacctcaggaccagacatcaactcagcacccatgacacattctcccatcaccccaccaacaattgtatggaccagtacaggcacaattgaacagtccactcaaccactacatgcagtttcttcagaaaaagtttctgtgcagacacagtcaactccatatgtcaactctgtggcagtgtctgcttcccctacccatgagaattcagtctcttctggaagcagcacatcctctccatattcctcagcctcacttgaatccttggattccacaatcagtaggaggaatgcaatcacttcctggctatgggacctcactacatctctccccactacaacttggccaagtactagtttatctgaggcactgtcctcaggccattctggggtttcaaacccaagttcaactacgactgaatttccactcttttcagctgcatccacatctgctgctaagcaaagaaatccagaaacagagacccatggtccccagaatacagccgcgagtactttgaacactgatgcatcctcggtcacaggtctttctgagactcctgtgggggcaagtatcagctctgaagtccctcttccaatggccataacttctagatcagatgtttctggccttacatctgagagtactgctaacccgagtttaggcacagcctcttcagcagggaccaaattaactaggacaatatccctgcccacttcagagtctttggtttcctttagaatgaacaaggatccatggacagtgtcaatccctttggggtcccatccaactactaatacagaaacaagcatcccagtaaacagcgcaggtccacctggcttgtccacagtagcatcagatgtaattgacacaccttcagatggggctgagagtattcccactgtctccttttccccctcccctgatactgaagtgacaactatctcacatttcccagaaaagacaactcattcatttagaaccatttcatctctcactcatgagttgacttcaagagtgacacctattcctggggattggatgagttcagctatgtctacaaagcccacaggagccagtccctccattacactgggagagagaaggacaatcacctctgctgctccaaccacttcccccatagttctcactgctagtttcacagagaccagcacagtttcactggataatgaaactacagtaaaaacctcagatatccttgacgcacggaaaacaaatgagctcccctcagatagcagttcttcttctgatctgatcaacacctccatagcttcttcaactatggatgtcactaaaacagcctccatcagtcccactagcatctcaggaatgacagcaagttcctccccatctctcttctcttcagatagaccccaggttcccacatctacaacagagacaaatacagccacctctccatctgtttccagtaacacctattctcttgatgggggctccaatgtgggtggcactccatccactttaccaccctttacaatcacccaccctgtcgagacaagctcggccctattagcctggtctagaccagtaagaactttcagcaccatggtcagcactgacactgcctccggagaaaatcctacctctagcaattctgtggtgacttctgttccagcaccaggtacatggaccagtgtaggcagtactactgacttacctgccatgggctttctcaagacaagtcctgcaggagaggcacactcacttctagcatcaactattgaaccagccactgccttcactccccatctctcagcagcagtggtcactggatccagtgctacatcagaagccagtcttctcactacgagtgaaagcaaagccattcattcttcaccacagaccccaactacacccacctctggagcaaactgggaaacttcagctactcctgagagccttttggtagtcactgagacttcagacacaacacttacctcaaagattttggtcacagataccatcttgttttcaactgtgtccacgccaccttctaaatttccaagtacggggactctgtctggagcttccttccctactttactcccggacactccagccatccctctcactgccactgagccaacaagttcattagctacatcctttgattccaccccactggtgactatagcttcggatagtcttggcacagtcccagagactaccctgaccatgtcagagacctcaaatggtgatgcactggttcttaagacagtaagtaacccagataggagcatccctggaatcactatccaaggagtaacagaaagtccactccatccttcttccacttccccctctaagattgttgctccacggaatacaacctatgaaggttcgatcacagtggcactttctactttgcctgcgggaactactggttcccttgtattcagtcagagttctgaaaactcagagacaacggctttggtagactcatcagctgggcttgagagggcatctgtgatgccactaaccacaggaagccagggtatggctagctctggaggaatcagaagtgggtccactcactcaactggaaccaaaacattttcttctctccctctgaccatgaacccaggtgaggttacagccatgtctgaaatcaccacgaacagactgacagctactcaatcaacagcacccaaagggatacctgtgaagcccaccagtgctgagtcaggcctcctaacacctgtctctgcctcctcaagcccatcaaaggcctttgcctcactgactacagctcccccaacttgggggatcccacagtctaccttgacatttgagttttctgaggtcccaagtttggatactaagtccgcttctttaccaactcctggacagtccctgaacaccattccagactcagatgcaagcacagcatcttcctcactgtccaagtctccagaaaaaaacccaagggcaaggatgatgacttccacaaaggccataagtgcaagctcatttcaatcaacaggttttactgaaacccctgagggatctgcctccccttctatggcagggcatgaacccagagtccccacttcaggaacaggggaccctagatatgcctcagagagcatgtcttatccagacccaagcaaggcatcatcagctatgacatcgacctctcttgcatcaaaactcacaactctcttcagcacaggtcaagcagcaaggtctggttctagttcctctcccataagcctatccactgagaaagaaacaagcttcctttcccccactgcatccacctccagaaagacttcactatttcttgggccttccatggcaaggcagcccaacatattggtgcatcttcagacttcagctctgacactttctccaacatccactctaaatatgtcccaggaggagcctcctgagttaacctcaagccagaccattgcagaagaagagggaacaacagctgaaacacagacgttaaccttcacaccatctgagaccccaacatccttgttacctgtctcttctcccacagaacccacagccagaagaaagagttctccagaaacatgggcaagctctatttcagttcctgccaagacctccttggttgaaacaactgatggaacgctagtgaccaccataaagatgtcaagccaggcagcacaaggaaattccacgtggcctgccccagcagaggagacggggaccagtccagcaggcacatccccaggaagcccagaaatgtctaccactctcaaaatcatgagctccaaggaacccagcatcagcccagagatcaggtccactgtgcgaaattctccttggaagactccagaaacaactgttcccatggagaccacagtggaaccagtcacccttcagtccacagccctaggaagtggcagcaccagcatctctcacctgcccacaggaaccacatcaccaaccaagtcaccaacagaaaatatgttggctacagaaagggtctccctctccccatccccacctgaggcttggaccaacctttattctggaactccaggagggaccaggcagtcactggccacaatgtcctctgtctccctagagtcaccaactgctagaagcatcacagggactggtcagcaaagcagtccagaactggtttcaaagacaactggaatggaattctctatgtggcatggctctactggagggaccacaggggacacacatgtctctctgagcacatcttccaatatccttgaagaccctgtaaccagcccaaactctgtgagctcattgacagataaatccaaacataaaaccgagacatgggtaagcaccacagccattccctccactgtcctgaataataagataatggcagctgaacaacagacaagtcgatctgtggatgaggcttattcatcaactagttcttggtcagatcagacatctgggagtgacatcacccttggtgcatctcctgatgtcacaaacacattatacatcacctccacagcacaaaccacctcactagtgtctctgccctctggagaccaaggcattacaagcctcaccaatccctcaggaggaaaaacaagctctgcgtcatctgtcacatctccttcaatagggcttgagactctgagggccaatgtaagtgcagtgaaaagtgacattgcccctactgctgggcatctatctcagacttcatctcctgcggaagtgagcatcctggacgtaaccacagctcctactccaggtatctccaccaccatcaccaccatgggaaccaactcaatctcaactaccacacccaacccagaagtgggtatgagtaccatggacagcaccccggccacagagaggcgcacaacttctacagaacacccttccacctggtcttccacagctgcatcagattcctggactgtcacagacatgacttcaaacttgaaagttgcaagatctcctggaacaatttccacaatgcatacaacttcattcttagcctcaagcactgaattagactccatgtctactccccatggccgtataactgtcattggaaccagcctggtcactccatcctctgatgcttcagctgtaaagacagagaccagtacaagtgaaagaacattgagtccttcagacacaactgcatctactcccatctcaactttttctcgtgtccagaggatgagcatctcagttcctgacattttaagtacaagttggactcccagtagtacagaagcagaagatgtgcctgtttcaatggtttctacagatcatgctagtacaaagactgacccaaatacgcccctgtccacttttctgtttgattctctgtccactcttgactgggacactgggagatctctgtcatcagccacagccactacctcagctcctcagggggccacaactccccaggaactcactttggaaaccatgatcagcccagctacctcacagttgcccttctctatagggcacattacaagtgcagtcacaccagctgcaatggcaaggagctctggagttactttttcaagaccagatcccacaagcaaaaaggcagagcagacttccactcagcttcccaccaccacttctgcacatccagggcaggtgcccagatcagcagcaacaactctggatgtgatcccacacacagcaaaaactccagatgcaacttttcagagacaagggcagacagctcttacaacagaggcaagagctacatctgactcctggaatgagaaagaaaaatcaaccccaagtgcaccttggatcactgagatgatgaattctgtctcagaagataccatcaaggaggttaccagctcctccagtgtattaaaggaccctgaatacgctggacataaacttggaatctgggacgacttcatccccaagtttggaaaagcagcccatatgagagagttgccccttctgagtccaccacaggacaaagaggcaattcacccttctacaaacacagtagagaccacaggctgggtcacaagttccgaacatgcttctcattccactatcccagcccactcagcgtcatccaaactcacatctccagtggttacaacctccaccagggaacaagcaatagtttctatgtcaacaaccacatggccagagtctacaagggctagaacagagcctaattccttcttgactattgaactgagggacgtcagcccttacatggacaccagctcaaccacacaaacaagtattatctcttccccaggttccactgcgatcaccaaggggcctagaacagaaattacctcctctaagagaatatccagctcattccttgcccagtctatgaggtcgtcagacagcccctcagaagccatcaccaggctgtctaactttcctgccatgacagaatctggaggaatgatccttgctatgcaaacaagtccacctggcgctacatcactaagtgcacctactttggatacatcagccacagcctcctggacagggactccactggctacgactcagagatttacatactcagagaagaccactctctttagcaaaggtcctgaggatacatcacagccaagccctccctctgtggaagaaaccagctcttcctcttccctggtacctatccatgctacaacctcgccttccaatattttgttgacatcacaagggcacagtccctcctctactccacctgtgacctcagttttcttgtctgagacctctggcctggggaagaccacagacatgtcgaggataagcttggaacctggcacaagtttacctcccaatttgagcagtacagcaggtgaggcgttatccacttatgaagcctccagagatacaaaggcaattcatcattctgcagacacagcagtgacgaatatggaggcaaccagttctgaatattctcctatcccaggccatacaaagccatccaaagccacatctccattggttacctcccacatcatgggggacatcacttcttccacatcagtatttggctcctccgagaccacagagattgagacagtgtcctctgtgaaccagggacttcaggagagaagcacatcccaggtggccagctctgctacagagacaagcactgtcattacccatgtgtctagtggtgatgctactactcatgtcaccaagacacaagccactttctctagcggaacatccatctcaagccctcatcagtttataacttctaccaacacatttacagatgtgagcaccaacccctccacctctctgataatgacagaatcttcaggagtgaccatcaccacccaaacaggtcctactggagctgcaacacagggtccatatctcttggacacatcaaccatgccttacttgacagagactccattagctgtgactccagattttatgcaatcagagaagaccactctcataagcaaaggtcccaaggatgtgacctggacaagccctccctctgtggcagaaaccagctatccctcttccctgacacctttcttggtcacaaccatacctcctgccacttccacgttacaagggcaacatacatcctctcctgtttctgcgacttcagttcttacctctggactggtgaagaccacagatatgttgaacacaagcatggaacctgtgaccaattcacctcaaaatttgaacaatccatcaaatgagatactggccactttggcagccaccacagatatagagactattcatccttccataaacaaagcagtgaccaatatggggactgccagttcagcacatgtactgcattccactctcccagtcagctcagaaccatctacagccacatctccaatggttcctgcctccagcatgggggacgctcttgcttctatatcaatacctggttctgagaccacagacattgagggagagccaacatcctccctgactgctggacgaaaagagaacagcaccctccaggagatgaactcaactacagagtcaaacatcatcctctccaatgtgtctgtgggggctattactgaagccacaaaaatggaagtcccctcttttgatgcaacattcataccaactcctgctcagtcaacaaagttcccagatattttctcagtagccagcagtagactttcaaactctcctcccatgacaatatctacccacatgaccaccacccagacagggtcttctggagctacatcaaagattccacttgccttagacacatcaaccttggaaacctcagcagggactccatcagtggtgactgaggggtttgcccactcaaaaataaccactgcaatgaacaatgatgtcaaggacgtgtcacagacaaaccctccctttcaggatgaagccagctctccctcttctcaagcacctgtccttgtcacaaccttaccttcttctgttgctttcacaccgcaatggcacagtacctcctctcctgtttctatgtcctcagttcttacttcttcactggtaaagaccgcaggcaaggtggatacaagcttagaaacagtgaccagttcacctcaaagtatgagcaacactttggatgacatatcggtcacttcagcagccaccacagatatagagacaacgcatccttccataaacacagtagttaccaatgtggggaccaccggttcagcatttgaatcacattctactgtctcagcttacccagagccatctaaaagtcacattctcccaatgttaccacctccaccatggaagacaccacaatttccacgatcaatacctaaatcctctaagactacaagaactgagactgagacaacttcctccctgactcctaaactgagggagaccagcatctcccaggagatcacctcgtccacagagacaagcactgttccttacaaagagctcactggtgccactaccgaggtatccaggacagatgtcacttcctctagcagtacatccttccctggccctgatcagtccacagtgtcactagacatctccacagaaaccaacaccaggctgtctacctccccaataatgacagaatctgcagaaataaccatcaccacccaaacaggtcctcatggggctacatcacaggatacttttaccatggacccatcaaatacaaccccccaggcagggatccactcagctatgactcatggattttcacaattggatgtgaccactcttatgagcagaattccacaggatgtatcatggacaagtcctccctctgtggataaaaccagctccccctcttcctttctgtcctcacctgcaatgaccacaccttccctgatttcttctaccttaccagaggataagctctcctctcctatgacttcacttctcacctctggcctagtgaagattacagacatattacgtacacgcttggaacctgtgaccagctcacttccaaatttcagcagcacctcagataagatactggccacttctaaagacagtaaagacacaaaggaaatttttccttctataaacacagaagagaccaatgtgaaagccaacaactctggacatgaatcccattcccctgcactggctgactcagagacacccaaagccacaactcaaatggttatcaccaccactgtgggagatccagctccttccacatcaatgccagtgcatggttcctctgagactacaaacattaagagagagccaacatatttcttgactcctagactgagagagaccagtacctctcaggagtccagctttcccacggacacaagttttctactttccaaagtccccactggtactattactgaggtctccagtacaggggtcaactcttctagcaaaatttccaccccagaccatgataagtccacagtgccacctgacaccttcacaggagagatccccagggtcttcacctcctctattaagacaaaatctgcagaaatgacgatcaccacccaagcaagtcctcctgagtctgcatcgcacagtacccttcccttggacacatcaaccacactttcccagggagggactcattcaactgtgactcagggattcccatactcagaggtgaccactctcatgggcatgggtcctgggaatgtgtcatggatgacaactccccctgtggaagaaaccagctctgtgtcttccctgatgtcttcacctgccatgacatccccttctcctgtttcctccacatcaccacagagcatcccctcctctcctcttcctgtgactgcacttcctacttctgttctggtgacaaccacagatgtgttgggcacaacaagcccagagtctgtaaccagttcacctccaaatttgagcagcatcactcatgagagaccggccacttacaaagacactgcacacacagaagccgccatgcatcattccacaaacaccgcagtgaccaatgtagggacttccgggtctggacataaatcacaatcctctgtcctagctgactcagagacatcgaaagccacacctctgatgagtaccacctccaccctgggggacacaagtgtttccacatcaactcctaatatctctcagactaaccaaattcaaacagagccaacagcatccctgagccctagactgagggagagcagcacgtctgagaagaccagctcaacaacagagacaaatactgccttttcttatgtgcccacaggtgctattactcaggcctccagaacagaaatctcctctagcagaacatccatctcagaccttgatcggcccacaatagcacccgacatctccacaggaatgatcaccaggctcttcacctcccccatcatgacaaaatctgcagaaatgaccgtcaccactcaaacaactactcctggggctacatcacagggtatccttccttgggacacatcaaccacacttttccagggagggactcattcaaccgtgtctcagggattcccacactcagagataaccactcttcggagcagaacccctggagatgtgtcatggatgacaactccccctgtggaagaaaccagctctgggttttccctgatgtcaccttccatgacatccccttctcctgtttcctccacatcaccagagagcatcccctcctctcctctccctgtgactgcacttcttacttctgttctggtgacaaccaccaatgtattgggcacaacaagcccagagaccgtaacgagttcacctccaaatttaagcagccccacacaggagagactgaccacttacaaagacactgcgcacacagaagccatgcatgcttccatgcatacaaacactgcagtggccaacgtcgggacctccatttctggacatgaatcacaatcttctgtcccagctgattcacacacatccaaagccacatctccaatgggtatcaccttcgccatgggggatacaagtgtttctacatcaactcctgccttctttgagactagaattcagactgaatcaacatcctctttgattcctggattaagggacaccaggacgtctgaggagatcaacactgtgacagagaccagcactgtcctttcagaagtgcccactactactactactgaggtctccaggacagaagttatcacttccagcagaacaaccatctcagggcctgatcattccaaaatgtcaccctacatctccacagaaaccatcaccaggctctccacttttccttttgtaacaggatccacagaaatggccatcaccaaccaaacaggtcctatagggactatctcacaggctacccttaccctggacacatcaagcacagcttcctgggaagggactcactcacctgtgactcagagatttccacactcagaggagaccactactatgagcagaagtactaagggcgtgtcatggcaaagccctccctctgtggaagaaaccagttctccttcttccccagtgcctttacctgcaataacctcacattcatctctttattccgcagtatcaggaagtagccccacttctgctctccctgtgacttcccttctcacctctggcaggaggaagaccatagacatgttggacacacactcagaacttgtgaccagctccttaccaagtgcaagtagcttctcaggtgagatactcacttctgaagcctccacaaatacagagacaattcacttttcagagaacacagcagaaaccaatatggggaccaccaattctatgcataaactacattcctctgtctcaatccactcccagccatccggacacacacctccaaaggttactggatctatgatggaggacgctattgtttccacatcaacacctggttctcctgagactaaaaatgttgacagagactcaacatcccctctgactcctgaactgaaagaggacagcaccgccctggtgatgaactcaactacagagtcaaacactgttttctccagtgtgtccctggatgctgctactgaggtctccagggcagaagtcacctactatgatcctacattcatgccagcttctgctcagtcaacaaagtccccagacatttcacctgaagccagcagcagtcattctaactctcctcccttgacaatatctacacacaagaccatcgccacacaaacaggtccttctggggtgacatctcttggccaactgaccctggacacatcaaccatagccacctcagcaggaactccatcagccagaactcaggattttgtagattcagaaacaaccagtgtcatgaacaatgatctcaatgatgtgttgaagacaagccctttctctgcagaagaagccaactctctctcttctcaggcacctctccttgtgacaacctcaccttctcctgtaacttccacattgcaagagcacagtacctcctctcttgtttctgtgacctcagtacccacccctacactggcgaagatcacagacatggacacaaacttagaacctgtgactcgttcacctcaaaatttaaggaacaccttggccacttcagaagccaccacagatacacacacaatgcatccttctataaacacagcaatggccaatgtggggaccaccagttcaccaaatgaattctattttactgtctcacctgactcagacccatataaagccacatccgcagtagttatcacttccacctcgggggactcaatagtttccacatcaatgcctagatcctctgcgatgaaaaagattgagtctgagacaactttctccctgatatttagactgagggagactagcacctcccagaaaattggctcatcctcagacacaagcacggtctttgacaaagcattcactgctgctactactgaggtctccagaacagaactcacctcctctagcagaacatccatccaaggcactgaaaagcccacaatgtcaccggacacctccacaagatctgtcaccatgctttctacttttgctggcctgacaaaatccgaagaaaggaccattgccacccaaacaggtcctcatagggcgacatcacagggtacccttacctgggacacatcaatcacaacctcacaggcagggacccactcagctatgactcatggattttcacaattagatttgtccactcttacgagtagagttcctgagtacatatcagggacaagcccaccctctgtggaaaaaaccagctcttcctcttcccttctgtctttaccagcaataacctcaccgtcccctgtacctactacattaccagaaagtaggccgtcttctcctgttcatctgacttcactccccacctctggcctagtgaagaccacagatatgctggcatctgtggccagtttacctccaaacttgggcagcacctcacataagataccgactacttcagaagacattaaagatacagagaaaatgtatccttccacaaacatagcagtaaccaatgtggggaccaccacttctgaaaaggaatcttattcgtctgtcccagcctactcagaaccacccaaagtcacctctccaatggttacctctttcaacataagggacaccattgtttccacatccatgcctggctcctctgagattacaaggattgagatggagtcaacattctccgtggctcatgggctgaagggaaccagcacctcccaggaccccatcgtatccacagagaaaagtgctgtccttcacaagttgaccactggtgctactgagacctctaggacagaagttgcctcttctagaagaacatccattccaggccctgatcattccacagagtcaccagacatctccactgaagtgatccccagcctgcctatctcccttggcattacagaatcttcaaatatgaccatcatcactcgaacaggtcctcctcttggctctacatcacagggcacatttaccttggacacaccaactacatcctccagggcaggaacacactcgatggcgactcaggaatttccacactcagaaatgaccactgtcatgaacaaggaccctgagattctatcatggacaatccctccttctatagagaaaaccagcttctcctcttccctgatgccttcaccagccatgacttcacctcctgtttcctcaacattaccaaagaccattcacaccactccttctcctatgacctcactgctcacccctagcctagtgatgaccacagacacattgggcacaagcccagaacctacaaccagttcacctccaaatttgagcagtacctcacatgagatactgacaacagatgaagacaccacagctatagaagccatgcatccttccacaagcacagcagcgactaatgtggaaaccaccagttctggacatgggtcacaatcctctgtcctagctgactcagaaaaaaccaaggccacagctccaatggataccacctccaccatggggcatacaactgtttccacatcaatgtctgtttcctctgagactacaaaaattaagagagagtcaacatattccttgactcctggactgagagagaccagcatttcccaaaatgccagcttttccactgacacaagtattgttctttcagaagtccccactggtactactgctgaggtctccaggacagaagtcacctcctctggtagaacatccatccctggcccttctcagtccacagttttgccagaaatatccacaagaacaatgacaaggctctttgcctcgcccaccatgacagaatcagcagaaatgaccatccccactcaaacaggtccttctgggtctacctcacaggatacccttaccttggacacatccaccacaaagtcccaggcaaagactcattcaactttgactcagagatttccacactcagagatgaccactctcatgagcagaggtcctggagatatgtcatggcaaagctctccctctctggaaaatcccagctctctcccttccctgctgtctttacctgccacaacctcacctcctcccatttcctccacattaccagtgactatctcctcctctcctcttcctgtgacttcacttctcacctctagcccggtaacgaccacagacatgttacacacaagcccagaacttgtaaccagttcacctccaaagctgagccacacttcagatgagagactgaccactggcaaggacaccacaaatacagaagctgtgcatccttccacaaacacagcagcgtccaatgtggagattcccagctctggacatgaatccccttcctctgccttagctgactcagagacatccaaagccacatcaccaatgtttattacctccacccaggaggatacaactgttgccatatcaacccctcacttcttggagactagcagaattcagaaagagtcaatttcctccctgagccctaaattgagggagacaggcagttctgtggagacaagctcagccatagagacaagtgctgtcctttctgaagtgtccgttggtgctactactgagatctccaggacagaagtcacctcctctagcagaacatccatctctggttctgctgagtccacaatgttgccagaaatatccaccacaagaaaaatcattaagttccctacttcccccatcctggcagaatcatcagaaatgaccatcaagacccaaacaagtcctcctgggtctacatcagagagtacctttacattagacacatcaaccactccctccttggtaataacccattcgactatgactcagagattgccacactcagagataaccactcttgtgagtagaggtgctggggatgtgccacggcccagctctctccctgtggaagaaacaagccctccatcttcccagctgtctttatctgccatgatctcaccttctcctgtttcttccacattaccagcaagtagccactcctcttctgcttctgtgacttcacttctcacaccaggccaagtgaagactactgaggtgttggacgcaagtgcagaacctgaaaccagttcacctccaagtttgagcagcacctcagttgaaatactggccacctctgaagtcaccacagatacggagaaaattcatcctttctcaaacacggcagtaaccaaagttggaacttccagttctggacatgaatccccttcctctgtcctacctgactcagagacaaccaaagccacatcggcaatgggtaccatctccattatgggggatacaagtgtttctacattaactcctgccttatctaacactaggaaaattcagtcagagccagcttcctcactgaccaccagattgagggagaccagcacctctgaagagaccagcttagccacagaagcaaacactgttctttctaaagtgtccactggtgctactactgaggtctccaggacagaagccatctcctttagcagaacatccatgtcaggccctgagcagtccacaatgtcacaagacatctccataggaaccatccccaggatttctgcctcctctgtcctgacagaatctgcaaaaatgaccatcacaacccaaacaggtccttcggagtctacactagaaagtacccttaatttgaacacagcaaccacaccctcttgggtggaaacccactctatagtaattcagggatttccacacccagagatgaccacttccatgggcagaggtcctggaggtgtgtcatggcctagccctccctttgtgaaagaaaccagccctccatcctccccgctgtctttacctgccgtgacctcacctcatcctgtttccaccacattcctagcacatatccccccctctccccttcctgtgacttcacttctcacctctggcccggcgacaaccacagatatcttgggtacaagcacagaacctggaaccagttcatcttcaagtttgagcaccacctcccatgagagactgaccacttacaaagacactgcacatacagaagccgtgcatccttccacaaacacaggagggaccaatgtggcaaccaccagctctggatataaatcacagtcctctgtcctagctgactcatctccaatgtgtaccacctccaccatgggggatacaagtgttctcacatcaactcctgccttccttgagactaggaggattcagacagagctagcttcctccctgacccctggattgagggagtccagtggctctgaagggaccagctcaggcaccaagatgagcactgtcctctctaaagtgcccactggtgctactactgagatctccaaggaagacgtcacctccatcccaggtcccgctcaatccacaatatcaccagacatctccacaagaaccgtcagctggttctctacatcccctgtcatgacagaatcagcagaaataaccatgaacacccatacaagtcctttaggggccacaacacaaggcaccagtactttggccacgtcaagcacaacctctttgacaatgacacactcaactatatctcaaggattttcacactcacagatgagcactcttatgaggaggggtcctgaggatgtatcatggatgagccctccccttctggaaaaaactagaccttccttttctctgatgtcttcaccagccacaacttcaccttctcctgtttcctccacattaccagagagcatctcttcctctcctcttcctgtgacttcactcctcacgtctggcttggcaaaaactacagatatgttgcacaaaagctcagaacctgtaaccaactcacctgcaaatttgagcagcacctcagttgaaatactggccacctctgaagtcaccacagatacagagaaaactcatccttcttcaaacagaacagtgaccgatgtggggacctccagttctggacatgaatccacttcctttgtcctagctgactcacagacatccaaagtcacatctccaatggttattacctccaccatggaggatacgagtgtctccacatcaactcctggcttttttgagactagcagaattcagacagaaccaacatcctccctgacccttggactgagaaagaccagcagctctgaggggaccagcttagccacagagatgagcactgtcctttctggagtgcccactggtgccactgctgaagtctccaggacagaagtcacctcctctagcagaacatccatctcaggctttgctcagctcacagtgtcaccagagacttccacagaaaccatcaccagactccctacctccagcataatgacagaatcagcagaaatgatgatcaagacacaaacagatcctcctgggtctacaccagagagtactcatactgtggacatatcaacaacacccaactgggtagaaacccactcgactgtgactcagagattttcacactcagagatgaccactcttgtgagcagaagccctggtgatatgttatggcctagtcaatcctctgtggaagaaaccagctctgcctcttccctgctgtctctgcctgccacgacctcaccttctcctgtttcctctacattagtagaggatttcccttccgcttctcttcctgtgacttctcttctcacccctggcctggtgataaccacagacaggatgggcataagcagagaacctggaaccagttccacttcaaatttgagcagcacctcccatgagagactgaccactttggaagacactgtagatacagaagacatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccacattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcatctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagcgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccagtgaagtgatcaccaggctctctacctcccccatcaaggcagaatctacagaaatgaccattaccacccaaacaggttctcctggggctacatcaaggggtacccttaccttggacacttcaacaacttttatgtcagggacccactcaactgcatctcaaggattttcacactcacagatgaccgctcttatgagtagaactcctggagatgtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccaccactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacagtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccgcttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgccctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggacgataccactgttttcacatcaaatcctgccttctctgagactaggaggattccgacagagccaacattctcattgactcctggattcagggagactagcacctctgaagagaccacctcaatcacagaaacaagtgcagtcctttatggagtgcccactagtgctactactgaagtctccatgacagaaatcatgtcctctaatagaacacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctccctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggatttaggaagacaaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcaacacccattttggataccagaatgacagagagcgttgagctgggaacagtgacaagtgcttatcaagttccttcactctcaacacggttgacaagaactgatggcatt

SEQ ID NO: 310 - protein, 10431 aa, Homo sapiens
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTDTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGTSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLKDPEYAGHKLGIWDDFIPKFGKAAHMRELPLLSPPQDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVTWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKSHILPMLPPPPWKTPQFPRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPETVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAMANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSVAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSSGHESPSSALADSETSKATSPMFITSTQEDTTVAISTPHFLETSRIQKESISSLSPKLRETGSSVETSSAIETSAVLSEVSVGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSLLTPGQVKTTEVLDASAEPETSSPPSLSSTSVEILATSEVTTDTEKIHPFSNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLATSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLTPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISSEVITRLSTSPIKAESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILATTEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRTHIPDSDQSTMSPDIITEVITRLSSSSMMSESTQMTITTQKSSPGATAQSTLTLATTTAPLARTHSTVPPRFLHSEMTTLMSRSPENPSWKSSPFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSTPILDTRMTESVELGTVTSAYQVPSLSTRLTRTDGI

SEQ ID NO: 311 - DNA, 57082 bp, Homo sapiens
  misc_feature (2205)..(11679): Exon 1
  misc_feature (13464)..(13570): Exon 2
  misc_feature (16177)..(34419): Exon 3
  misc_feature (34420)..(34534): n is a, c, g, or t
  misc_feature (34575)..(38024): Exon 4
  misc_feature (38689)..(38800): Exon 5
  misc_feature (39715)..(39771): n is a, c, g, or t
  misc_feature (40578)..(45257): Exon 6
  misc_feature (47360)..(47395): Exon 7
  misc_feature (52407)..(52442): Exon 8
  misc_feature (52686)..(52744): Exon 9
ggtgcgcaccactatgtctggctaatttttgtatttttttgtagagacatggtttcaccatgttggccaggctggtctcgaattcctgacttcaagtaatccacccacctcagcctcccaaagtgctgggattacaagcatgagccaccatgcatggcctaaagcttcttttaaagccaccaagtcccttcccatgttagcccactaatccatgggttagtcatgaatggattaatctattcatacggacagagccctcatcacccaatcacctcttaaaggccccacctctcaatactgccacactggggattaagtttcaacagagttttggaggggacattcaaatcatagtaatgcccaaagtgaaaaatcttccctgcacttttccctcaacaaaaacagccagagatagtgagctgccaggaaattcttttttttttcctcttctgtcctaaatcagcatcgctagacctttacatgattcaacctcatcttcttcaccctctgggtcatgaaattttatttatttatttattattttcttgggacagactctggctctgtcgcccaggctgaagtgcagtggtgtgatcttggctcactgcaacctccgcctcccgggttcaagcgattctcctgcctcagcctcctgagtagctgggattacaggtgggcgccaccacacccagctaattttttgtatttttagtagagatggggtttcaccatattagccaggatggtctccatctcttgacctcgtgatctgcccacctcagcctcccaaaatgctgggattacaggcatgagacaccacgcccagcaggccagggtcatgagattttaatcaagagcaacttccactgattcctgagagtgcatctgtgggcccctgctctgatctgaacagaagtgccgtgtcttctctgacctccacttctcaattcaagagccttagtatctgccagtatcacacactgagcattagctccatctcatgggggtgtaggtaggggctctatctgcatctttctttctttttttctttctttcccttcctcccttcctcactccctcggtcctctctttctttccttttctttcttccttcctcccttcctccctccctccctctctctttctctctttctttctttccttctttctttctttctctcttccttccctccctccctccttccttcctttctctttctttctctttctttctttttttccttccttccttccttctttctctttctctccctcccttccttccttccttccttccttccttcctttctttctttctttctttctttctttctttctttctttctttctttctttcttccttccttccttccttccttccttccttccttccttcctttcttttctttctttctctttctttttgagacagagctcttattacccatgctggagtgcagtggtgtgaccttggcttactgcaacatctgcctcctagggtcaagtgattctcctgcctcagcctcctaagtagctgggattacagacacatgccaccacacccaatatttatttttattaaaattttttttaaaattatttttaaaaaattaaaaataattttgtatttttagtagagacggggtttctccatgttggtcaggctgatctcaaactcccaacctcaggtgatcctcccacctcacctcccaaagtgctgggattacaggcatgagccaccgtgcccagcctggttcctggtttctaagacatcacacacacacacacacacacacacacacactcacacactcagagagagagagagagagaggatcattaagacatgatacactaagaaattctattctgcagacactgagaatccgttaaaaagtttgaagggaagaattgagatcatcaggtgtttatttgaggaaattgtctgtggttgaactatcctttcctttctctccctgagatttggtcttctcaattagaagcgttgcacaattcccccaacctccatacatacggcagctcttctagacacaggttttcccaggtcaaatgcggggaccccagccatatctcccaccctgagaaattttggagtttcagggagctcagaagctctgcagaggccaccctctctgaggggattcttcttagacctccatccagaggcaaatgttgacctgtccatgctgaaaccctcaggccttcctgggtcatcttctcccacccgctccttgatgacagggagcaggagcactaaagccacaccagaaatggattcaggactgacaggagccaccttgtcacctaagacatctacaggtgcaatcgtggtgacagaacatactctgccctttacttccccagataagaccttggccagtcctacatcttcggttgtgggaagaaccacccagtctttgggggtgatgtcctctgctctccctgagtcaacctctagaggaatgacacactccgagcaaagaaccagcccatcgctgagtccccaggtcaatggaactccctctaggaactaccctgctacaagcatggtttcaggattgagttccccaaggaccaggaccagttccacagaaggaaattttaccaaagaagcatctacatacacactcactgtagagaccacaagtggcccagtcactgagaagtacacagtccccactgagacctcaacaactgaaggtgacagcacagagaccccctgggacacaagatatattcctgtaaaaatcacatctccaatgaaaacatttgcagattcaactgcatccaaggaaaatgccccagtgtctatgactccagctgagaccacagttactgactcacatactccaggaaggacaaacccatcatttgggacactttattcttccttccttgacctatcacctaaagggaccccaaattccagaggtgaaacaagcctggaactgattctatcaaccactggatatcccttctcctctcctgaacctggctctgcaggacacagcagaataagtaccagtgcgcctttgtcatcatctgcttcagttctcgataataaaatatcagagaccagcatattctcaggccagagtctcacctcccctctgtctcctggggtgcccgaggccagagccagcacaatgcccaactcagctatccctttttccatgacactaagcaatgcagaaacaagtgccgaaagggtcagaagcacaatttcctctctggggactccatcaatatccacaaagcagacagcagagactatccttaccttccatgccttcgctgagaccatggatatacccagcacccacatagccaagactttggcttcagaatggttgggaagtccaggtacccttggtggcaccagcacttcagcgctgacaaccacatctccatctaccactttagtctcagaggagaccaacacccatcactccacgagtggaaaggaaacagaaggaactttgaatacatctatgactccacttgagacctctgctcctggagaagagtccgaaatgactgccaccttggtccccactctaggttttacaactcttgacagcaagatcagaagtccatctcaggtctcttcatcccacccaacaagagagctcagaaccacaggcagcacctctgggaggcagagttccagcacagctgcccacgggagctctgacatcctgagggcaaccacttccagcacctcaaaagcatcatcatggaccagtgaaagcacagctcagcaatttagtgaaccccagcacacacagtgggtggagacaagtcctagcatgaaaacagagagacccccagcatcaaccagtgtggcagcccctatcaccacttctgttccctcagtggtctctggcttcaccaccctgaagaccagctccacaaaagggatttggcttgaagaaacatctgcagacacactcatcggagaatccacagctggcccaaccacccatcagtttgctgttcccactgggatttcaatgacaggaggcagcagcaccaggggaagccagggcacaacccacctactcaccagagccacagcatcatctgagacatccgcagatttgactctggccacgaacggtgtcccagtctccgtgtctccagcagtgagcaagacggctgctggctcaagtcctccaggagggacaaagccatcatatacaatggtttcttctgtcatccctgagacatcatctctacagtcctcagctttcagggaaggaaccagcctgggactgactccattaaacactagacatcccttctcttcccctgaaccagactctgcaggacacaccaagataagcaccagcattcctctgttgtcatctgcttcagttcttgaggataaagtgtcagcgaccagcacattctcacaccacaaagccacctcatctattaccacagggactcctgaaatctcaacaaagacaaagcccagctcagccgttctttcctccatgaccctaagcaatgcagcaacaagtcctgaaagagtcagaaatgcaacttcccctctgactcatccatctccatcaggggaagagacagcagggagtgtcctcactctcagcacctctgctgagactacagactcacctaacatccacccaactgggacactgacttcagaatcgtcagagagtcctagcactctcagcctcccaagtgtctctggagtcaaaaccacattttcttcatctactccttccactcatctatttactagtggagaagaaacagaggaaacttcgaatccatctgtgtctcaacctgagacttctgtttccagagtaaggaccaccttggccagcacctctgtccctaccccagtattccccaccatggacacctggcctacacgttcagctcagttctcttcatcccacctagtgagtgagctcagagctacgagcagtacctcagttacaaactcaactggttcagctcttcctaaaatatctcacctcactgggacggcaacaatgtcacagaccaatagagacacgtttaatgactctgctgcaccccaaagcacaacttggccagagactagtcccagattcaagacagggttaccttcagcaacaaccactgtttcaacctctgccacttctctctctgctactgtaatggtctctaaattcacttctccagcaactagttccatggaagcaacttctatcagggaaccatcaacaaccatcctcacaacagagaccacgaatggcccaggctctatggctgtggcttctaccaacatcccaattggaaagggctacattactgaaggaagattggacacaagccatctgcccattggaaccacagcttcctctgagacatctatggattttaccatggccaaagaaagtgtctcaatgtcagtatctccatctcagtccatggatgctgctggctcaagcactccaggaaggacaagccaattcgttgacacattttctgatgatgtctatcatttaacatccagagaaattacaatacctagagatggaacaagctcagctctgactccacaaatgactgcaactcaccctccatctcctgatcctggctctgctagaagcacctggcttggcatcttgtcctcatctccttcttctcctactcccaaagtcacaatgagctccacattttcaactcagagagtcaccacaagcatgataatggacacagttgaaactagtcggtggaacatgcccaacttaccttccacgacttccttgacaccaagtaatattccaacaagtggtgccataggaaaaagcaccctggttcccttggacactccatctccagccacatcattggaggcatcagaagggggacttccaaccctcagcacctaccctgaatcaacaaacacacccagcatccacctcggagcacacgctagttcagaaagtccaagcaccatcaaacttaccatggcttcagtagtaaaacctggctcttacacacctctcaccttcccctcaatagagacccacattcatgtatcaacagccagaatggcttactcttctgggtcttcacctgagatgacagctcctggagagactaacactggtagtacctgggaccccaccacctacatcaccactacggatcctaaggatacaagttcagctcaggtctctacaccccactcagtgaggacactcagaaccacagaaaaccatccaaagacagagtccgccaccccagctgcttactctggaagtcctaaaatctcaagttcacccaatctcaccagtccggccacaaaagcatggaccatcacagacacaactgaacactccactcaattacattacacaaaattggcagaaaaatcatctggatttgagacacagtcagctccaggacctgtctctgtagtaatccctacctcccctaccattggaagcagcacattggaactaacttctgatgtcccaggggaacccctggtccttgctcccagtgagcagaccacaatcactctccccatggcaacatggctgagtaccagtttgacagaggaaatggcttcaacagaccttgatatttcaagtccaagttcacccatgagtacatttgctatttttccacctatgtccacaccttctcatgaactttcaaagtcagaggcagataccagtgccattagaaatacagattcaacaacgttggatcagcacctaggaatcaggagtttgggcagaactggggacttaacaactgttcctatcaccccactgacaaccacgtggaccagtgtgattgaacactcaacacaagcacaggacaccctttctgcaacgatgagtcctactcacgtgacacagtcactcaaagatcaaacatctataccagcctcagcatccccttcccatcttactgaagtctaccctgagctcgggacacaagggagaagctcctctgaggcaaccactttttggaaaccatctacagacacactgtccagagagattgagactggcccaacaaacattcaatccactccacccatggacaacacaacaacagggagcagtagtagtggagtcaccctgggcatagcccaccttcccataggaacatcctccccagctgagacatccacaaacatggcactggaaagaagaagttctacagccactgtctctatggctgggacaatgggactccttgttactagtgctccaggaagaagcatcagccagtcattaggaagagtttcctctgtcctttctgagtcaactactgaaggagtcacagattctagtaagggaagcagcccaaggctgaacacacagggaaatacagctctctcctcctctcttgaacccagctatgctgaaggaagccagatgagcacaagcatccctctaacctcatctcctacaactcctgatgtggaattcatagggggcagcacattttggaccaaggaggtcaccacagttatgacctcagacatctccaagtcttcagcaaggacagagtccagctcagctacccttatgtccacagctttgggaagcactgaaaatacaggaaaagaaaaactcagaactgcctctatggatcttccatctccaactccatcaatggaggtgacaccatggatttctctcactctcagtaatgcccccaataccacagattcacttgacctcagccatggggtgcacaccagctctgcagggactttggccactgacaggtcattgaatactggtgtcactagagcctccagattggaaaacggctctgatacctcttctaagtccctgtctatgggaaacagcactcacacttccatgacttacacagagaagagtgaagtgtcttcttcaatccatccccgacctgagacctcagctcctggagcagagaccactttgacttccactcctggaaacagggccataagcttaacattgcctttttcatccattccagtggaagaagtcatttctacaggcataacctcaggaccagacatcaactcagcacccatgacacattctcccatcaccccaccaacaattgtatggaccagtacaggcacaattgaacagtccactcaaccactacatgcagtttcttcagaaaaagtttctgtgcagacacagtcaactccatatgtcaactctgtggcagtgtctgcttcccctacccatgagaattcagtctcttctggaagcagcacatcctctccatattcctcagcctcacttgaatccttggattccacaatcagtaggaggaatgcaatcacttcctggctatgggacctcactacatctctccccactacaacttggccaagtactagtttatctgaggcactgtcctcaggccattctggggtttcaaacccaagttcaactacgactgaatttccactcttttcagctgcatccacatctgctgctaagcaaagaaatccagaaacagagacccatggtccccagaatacagccgcgagtactttgaacactgatgcatcctcggtcacaggtctttctgagactcctgtgggggcaagtatcagctctgaagtccctcttccaatggccataacttctagatcagatgtttctggccttacatctgagagtactgctaacccgagtttaggcacagcctcttcagcagggaccaaattaactaggacaatatccctgcccacttcagagtctttggtttcctttagaatgaacaaggatccatggacagtgtcaatccctttggggtcccatccaactactaatacagaaacaagcatcccagtaaacagcgcaggtccacctggcttgtccacagtagcatcagatgtaattgacacaccttcagatggggctgagagtattcccactgtctccttttccccctcccctgatactgaagtgacaactatctcacatttcccagaaaagacaactcattcatttagaaccatttcatctctcactcatgagttgacttcaagagtgacacctattcctggggattggatgagttcagctatgtctacaaagcccacaggagccagtccctccattacactgggagagagaaggacaatcacctctgctgctccaaccacttcccccatagttctcactgctagtttcacagagaccagcacagtttcactggataatgaaactacagtaaaaacctcagatatccttgacgcacggaaaacaaatgagctcccctcagatagcagttcttcttctgatctgatcaacacctccatagcttcttcaactatggatgtcactaaaacagcctccatcagtcccactagcatctcaggaatgacagcaagttcctccccatctctcttctcttcagatagaccccaggttcccacatctacaacagagacaaatacagccacctctccatctgtttccagtaacacctattctcttgatgggggctccaatgtgggtggcactccatccactttaccaccctttacaatcacccaccctgtcgagacaagctcggccctattagcctggtctagaccagtaagaactttcagcaccatggtcagcactgacactgcctccggagaaaatcctacctctagcaattctgtggtgacttctgttccagcaccaggtacatggaccagtgtaggcagtactactgacttacctgccatgggctttctcaagacaagtcctgcaggagaggcacactcacttctagcatcaactattgaaccagccactgccttcactccccatctctcagcagcagtggtcactggatccagtgctacatcagaagccagtcttctcactacgagtgaaagcaaagccattcattcttcaccacagaccccaactacacccacctctggagcaaactgggaaacttcagctactcctgagagccttttggtagtcactgagacttcagacacaacacttacctcaaagattttggtcacagataccatcttgttttcaactgtgtccacgccaccttctaaatttccaagtacggggactctgtctggagcttccttccctactttactcccggacactccagccatccctctcactgccactgagccaacaagttcattagctacatcctttgattccaccccactggtgactatagcttcggatagtcttggcacagtcccagagactaccctgaccatgtcagagacctcaaatggtgatgcactggttcttaagacagtaagtaacccagataggagcatccctggaatcactatccaaggagtaacagaaagtccactccatccttcttccacttccccctctaagattgttgctccacggaatacaacctatgaaggttcgatcacagtggcactttctactttgcctgcgggaactactggttcccttgtattcagtcagagttctgaaaactcagagacaacggctttggtagactcatcagctgggcttgagagggcatctgtgatgccactaaccacaggaagccagggtatggctagctctggaggaatcagaagtgggtccactcactcaactggaaccaaaacattttcttctctccctctgaccatgaacccaggtgaggttacagccatgtctgaaatcaccacgaacagactgacagctactcaatcaacagcacccaaagggatacctgtgaagcccaccagtgctgagtcaggcctcctaacacctgtctctgcctcctcaagcccatcaaaggcctttgcctcactgactacagctcccccaacttgggggatcccacagtctaccttgacatttgagttttctgaggtcccaagtttggatactaagtccgcttctttaccaactcctggacagtccctgaacaccattccagactcagatgcaagcacagcatcttcctcactgtccaagtctccagaaaaaaacccaagggcaaggatgatgacttccacaaaggccataagtgcaagctcatttcaatcaacaggttttactgaaacccctgagggatctgcctccccttctatggcagggcatgaacccagagtccccacttcaggaacaggggaccctagatatgcctcagagagcatgtcttatccagacccaagcaaggcatcatcagctatgacatcgacctctcttgcatcaaaactcacaactctcttcagcacaggtcaagcagcaaggtctggttctagttcctctcccataagcctatccactgagaaagaaacaagcttcctttcccccactgcatccacctccagaaagacttcactatttcttgggccttccatggcaaggcagcccaacatattggtgcatcttcagacttcagctctgacactttctccaacatccactctaaatatgtcccaggaggagcctcctgagttaacctcaagccagaccattgcagaagaagagggaacaacagctgaaacacagacgttaaccttcacaccatctgagaccccaacatccttgttacctgtctcttctcccacagaacccacagccagaagaaagagttctccagaaacatgggcaagctctatttcagttcctgccaagacctccttggttgaaagtaagaatgccctgctccttccccaagtgtgctggggatgaatctggaaataaactacatcttttttattttttaaacttttatatttgaaaatataaatattttaggttcagggaacatgtgcaggtttgttatataggtaaattgcatgtcatgggggcttggggtacagattacatcatcagccaggtaataagcctagtacctgatcagtagattttttttaatcctctccctcctcccagcctccaccctcaattcacatgtctccatgtgtactcaaggtttaattcccacttatgagtgagaacatgcggtatttgtaaactacatctttatttttgctaacctcgaactgaaatttagcatttgttttattgatgaatagaggtaacaaaacaaaccacattaatcctagcagtgcctgtgcctttgccaacaacagaaattccggacactttcatatcctatgacaattgttgcaagcacttttaaaaatcatgtacgactttattcataattatagtggttattaggcttttcaatagatcttatttaatgagttagtaaaataagtgcctgtattattgtattacatttgtttattaagatcttgataacaacatttcaatataatcatttcctttgttttttaaattttagattcaggggtatatgtgcaggtttgttacgtggatatactgcataatgatgaggtttggcttctagtgaacccatcagccaaatagtgaatgttgtgcccaataagtagtttttcaatcctcacttcactcccagcctcctctattttggagtcccagtgtctattatttctatctttatgtccacatgtacccattggttagctcccacttataagtgagaatgtgcagtatttaattttctgtttttgagttattttgcttaggttgatggccttcagctccagccacgttgctttaaagaacatgatttcattcttttttatggctgcatagtactccgaggtgtatgtgtaccagattttctttatccacaatgatttcctttgtaatctaatattttatattgttattttatgttttattctatatttttattttaatttataaaggaattcatatggttcacaagcctgtcaaagggacctataataaaaagaggttaagaatccatgctctaaacagaatattactccattttatttcatttatttttaaagagacagtctcactctgtcatccaggctggagtacagtggagtgatcatagctcattgcaaccctgaactcttgggcacaagcaattctcctgcttcatcctccagaggagctgggactacaggtgcacatcaccatgcccagctagttttaaaaattattttgtagagatggtgtctcactatcctacccaggctggtctcaaactcctgggctcaggcaatcctcccactttgacctcccaaagtgttgagattacaggggcaagccactgtgcctggccacttgtcacattttaatttgtgattacttataaaatgaaccccttcccatctgagatctgtcagtctttctggtgacggtgcctggtgtctgctttctaccatgtcctgttagactagtgtttgatgggaggtcacctgggcagctgtccagctcactcactgggctctagagcctctgagttgaagcaaaatagaaagatcagtcaatgtaaagaaagctcaaaaactgacattctgaagtaatggatagctaaaccttcctattgcccttttctttcagcaactgatggaacgctagtgaccaccataaagatgtcaagccaggcagcacaaggaaattccacgtggcctgccccagcagaggagacggggaccagtccagcaggtaaatatagaccttgtttccatttctgctctgctaatgccacccaagcctttcttttcttttcttttcttttcttttcttttcttttcttttcttttctttctctccctttctttctttctttctttctttctttctttctttctttctttctttctttctctttctttctttctttctttctttctttctttctttctttctttctttctctttctttcttctttctctctctctctttctttctttctcttgttctttttaaattttttatttttttacttaatttttttcacccaagccttaaggccagtttggaccagatagtgagaccccacctctataaaaaaaatttttaaaaaaaaaataagttgggcatcgtgcaggcctgtagtccctgctactcgagaggccaaggtgggaggacagcttgctgctgactaaaagtgctgcttattgattctgggaagaaaaaatatacaaggcttcagtttcattattttataagtaaatgctagcaacttttcctttctttctctctttctctcttcctctctttctctcctctccttctcttctctctctctctctctctctctctctttctctctcctctccttctcttctcttctttctctctctctctctttcatttatttttgagacatggtctcattctgtcacccaggctggagtacagtggtgtatatttactgcagtactcactgtactcactgcagcctcaaattcctgggctcaagctatcctctcacctcagcctcctgagtagctgggcagcagtccagctcactcactgggctctagagcctctgtgctatgcccagcttattgttgttgtttttttaaatttttttttttgtacagatggggtctcactatgtggcccaaggtggtcttaaactcctggctccaagagatcctcccacctcagcctcccaaagtgcagggattacaggtgtgagccactgtgcccagcctagacagcattttttttttttgaaacagggtctccctctgttgcccaggctggagtgcaatggcgtgttcatggttcactgcagcctcagcctcctcagtctcaagcaatcctccaacttcagcctcccccaacagctagaactgcaggtgatcatcaccaattagcctggttaattgtgtgtgtatttcttaaattttttgtagagatagttctcactatattgcttgggctggtctcaaactcctggactcaagtgattcacctacctcggcctccctaagcactgggattacaggcttgagccaccacacccggcaaggactaggttttaaaataggttcctaggctgggtgtggtggcttacgcccgtaatcccagcactttgggaggctgaggtgggcggatcacgaggtcaggagtttgagaccagcctggccaacatagtgaaaccctgtctctactaaaaatacaaaaaattagctgggcatagtggcacacacctgtaatcccagctactcgggaggctgaggaaggagaatcacttgaacctgggaggcggaggttgcagtgagccgagatcatgccattgctctccagcctgggtgacagagcaagactccatctaaaaaaaaaaaaaaaagttcctttgacttcttgacactcttctctgaggatattgatcatttttccccaatagatgttactaattgaacacttctgttgcttcaacttactaatttacatgatcaatagccaattaattcagcaggagagaatgctacagagtcgattctttctgtactttcttctgctccagagtgaaggatctttctaaatcagagaccatcactgtgttcacagggagggcctaggtgaacctgagatggcaaatgttgcgtttgttctacggaagaagggattatgggttgaagtccttggcagtgccaaattgcttagaaaaatgtgaaatatggtccctaggagtgctcttgggatgtcacatttttctcactcctttgacaggtagatgttattttcctgaaggccagggaaaggattcagagggaggaatgaatttgaaagaaaatgaaggtgacgagaaagaatgagctcatctcccttatcctctttcttctcaaatccttaagtagctttgcagtgaactaagatttgggggaacctagaggaggctgaaagttggaagctgaaattggcttagcaagggcaagctccaaagacaaaagtggaaatagtttgggggtagccttttgcatgggtgaaatcctggttcatcacatcctcccttatgcaaagagcccttttatatggggcatggggaaaaactgagctaaaggtgataatttctcctgagcaagccagatggtcaaagctctaacttcaccatctcccttggaatgtttaatgtgttccctggtgtccagaggcttaacgtgtgagaattaaaagctcaacattttctttcccagggaaggaggaaatagttttaattgaaatcccgggaggaaatgaatgatagtgtcaaaccaaaaaacttcatcttctgtaccacttgcatatactccactgacttactttctaatcacaggcacatccccaggaagcccagaaatgtctaccactctcaaaatcatgagctccaaggaacccggcatcagcccagagatcaggtccactgtgagaaattctccttggaagactccagaaacaactgttcccatggagaccacagtggaaccagtcacccttcagtccacagccctaggaagtggcagcaccagcatctctcacctgcccacaggaaccacatcaccaaccaagtcaccaacagaaaatatgttggctacagaaagggtctccctctccccatccccacctgaggcttggaccaacctttattctggaactccaggagggaccaggcagtcactggccacaatgtcctctgtctccctagagtcaccaactgctagaagcatcacagggactggtcagcaaagcagtccagaactggttttaaagacaactggaatggaattctctatgtggcatggctctactggagggaccacaggggacacacatgtctctctgagcacatcttccaatatccttgaagaccctgtaaccagcccaaactctgtgagctcattgacagataaatccaaacataaaaccgagacatgggtcagcaccacagccattccctccactgtcctgaataataagataatggcagctgaacaacagacaagtcgatctgtggatgaggcttattcatcaactagttcttggtcagatcagacatctgggagtgacatcacccttggtgcatctcctgatgtcacaaacacattatacatcacctccacagcacaaaccacctcactagtatctctgccctctggagaccaaggcattacaagcctcaccaatccctcaggaggaaaaacaagctctgcatcatctgtcacatctccttcaatagggcttgagactctgatggccaatgtaagtgcagtgacaagtgacattgcccctactgctgggcatctatctcagacttcatctcctgcggaagtgagcatcctggacataaccacagctcctactccaggtatctccaccaccatcaccaccatgggaaccaactcaatctcaactaccacacccaacccagaagtgggtatgagtaccatggacagcaccccggccacagagaggcacacaacttctacagaacacccttccacctggtcttccacagctgcatcagattcctggactgtcacagacatgacttcaaacttgaaagttgcaagatctcctggaacaatttccacaatgcatacaacttcattcttagcctcaagcactgaattagactccatgtctactccccatggccgtataactgtcattggaaccagcctggtcactccatcctctgatgcttcagctgtaaagacagagaccagtacaagtgaaagaacattgagtccttcagacacaactgcatctactcccatctcaactttttctcgtgtccagaggatgagcatctcagttcctgacattttaagtacaagttggactcccagtagtacagaagcagaagatgtgcctgtttcaatggtttctacagatcatgctagtacaaagactgacccaaatatgcccctgtccacttttctgtttgattctctgtccactcttgactgggacactgggagatctctgtcatcagccacagccactacctcagctcctcagggggccacaactccccaagaactcactttggaaaccatgatcagcccagctacctcacagttgcccttctctatagggcacattacaagtgcagtcataccagctgcaatggcaaggagctctggagttactttttcaagaccagatcccacaagcaaaaaggcagagcagacttccactcagcttcccaccaccacttctgcacatccagagcaggtgcccagatcagcagcaacaactctggatgtgatcccacacacagcaaaaactccagatgcaacttttcagagacaagggcagacagctcttacaacagaggcaagagctacatctgactcctggaatgagaaagaaaaatcaaccccaagtgcaccttggatcactgagatgatgaattctgtctcagaagataccatcaaggaggttaccagctcctccagtgtgttaaggaccctgaatacgctggacataaacttggaatctgggacgacttcatccccaagttggaaaagcagcccatatgagagaattgccccttctgagtctaccacagacaaagaggcaattcacccttctacaaacacagtagagaccactggctgggtcacaagttccgaacatgcttctcattccactatcccagcccactcagcgtcatccaaactcacatctccagtggttacaacctccaccagggaacaagcaatagtttctatgtcaacaaccacatggccagagtctacaagggctagaacagagcctaattccttcttgactattgaactgagggacgtcagcccttacatggacaccagctcaaccacacaaacaagttttatctcttccccaggttccactgcgatcaccaaggggcctagaacagaaattacctcctctaagagaatatccagctcattccttgcccagtctatgaggtcgtcagacagcccctcagaagccatctccaggctgtctaactttcctgccatgacagaatctggaggaatgatccttgctatgcaaacaagtccacctggcgctacatcactaagtgcacctactttggatacatcagccacagcctcctggacagggactccactggctacgactcagagatttacatactcagagaagaccactctctttagcaaaggtcctgaggatacatcacagccaagccctccctctgtggaagaaaccagctcttcctcttccctggtacctatcaatgctacaacctcgccttccaatattttgttgacatcacaagggcacagtccctcctctactccacctgtgacctcagttttcttgtctgagacctctggcctggggaagaccacagacatgtcgaggataagcttggaacctggcacaagtttacctcccaatttgagcagtacagcaggtgaggcgttatccacttatgaagcctccagagatacaaaggcaattcatcattctgcagacacagcagtgacgaatatggaggcaaccagttctgaatattctcctatcccaggccatacaaagccatccaaagccacatctccattggttacctcccacatcatgggggacatcacttcttccacatcagtatttggctcctccgagaccacagagattgagacagtgtcctctgtgaaccagggacttcaggagagaagcacatcccaggtggccagctctgctacagagacaagcactgtcattacccatgtgtctagtggtgatgctactactcatgtcaccaagacacaagccactttctctagcggaacatccatctcaagccctcatcagtttataacttctaccaacacatttacagatgtgagcaccaacccctccacctctctgataatgacagaatcttcaggagtgaccatcaccacccaaacaggtcctactggagctgcaacacagggtccatatctcttggacacatcaaccatgccttacttgacagagactccattagctgtgactccagattttatgcaatcagagaagaccactctcataagcaaaggtcccaaggatgtgtcctggacaagccctccctctgtggcagaaaccagctatccctcttccctgacacctttcttggtcacaaccatacctcctgccacttccacgttacaagggcaacatacatcctctcctgtttctgcgacttcagttcttacctctggactggtgaagaccacagatatgttgaacacaagcatggaacctgtgaccaattcacctcaaaatttgaacaatccatcaaatgagatactggccactttggcagccaccacagatatagagactattcatccttccataaacaaagcagtgaccaatatggggactgccagttcagcacatgtactgcattccactctcccagtcagctcagaaccatctacagccacatctccaatggttcctgcctccagcatgggggacgctcttgcttctatatcaatacctggttctgagaccacagacattgagggagagccaacatcctccctgactgctggacgaaaagagaacagcaccctccaggagatgaactcaactacagagtcaaacatcatcctctccaatgtgtctgtgggggctattactgaagccacaaaaatggaagtcccctcttttgatgcaacattcataccaactcctgctcagtcaacaaagttcccagatattttctcagtagccagcagtagactttcaaactctcctcccatgacaatatctacccacatgaccaccacccagacagggtcttctggagctacatcaaagattccacttgccttagacacatcaaccttggaaacctcagcagggactccatcagtggtgactgaggggtttgcccactcaaaaataaccactgcaatgaacaatgatgtcaaggacgtgtcacagacaaaccctccctttcaggatgaagccagctctccctcttctcaagcacctgtccttgtcacaaccttaccttcttctgttgctttcacaccgcaatggcacagtacctcctctcctgtttctatgtcctcagttcttacttcttcactggtaaagaccgcaggcaaggtggatacaagcttagaaacagtgaccagttcacctcaaagtatgagcaacactttggatgacatatcggtcacttcagcagccaccacagatatagagacaacgcatccttccataaacacagtagttaccaatgtggggaccaccggttcagcatttgaatcacattctactgtctcagcttacccagagccatctaaagtcacatctccaaatgttaccacctccaccatggaagacaccacaatttccagatcaatacctaaatcctctaagactacaagaactgagactgagacaacttcctccctgactcctaaactgagggagaccagcgtctcccaggagatcacctcgtccacagagacaagcactgttccttacaaagagctcactggtgccactaccgaggtatccaggacagatgtcacttcctctagcagtacatccttccctggccctgatcagtccacagtgtcactagacatctccacagaaaccaacaccaggctgtctacctccccaataatgacagaatctgcagaaataaccatcaccacccaaacaggtcctcatggggctacatcacaggatacttttaccatggacccatcaaatacaaccccccaggcagggatccactcagctatgactcatggattttcacaattggatgtgaccactcttatgagcagaattccacaggatgtatcatggacaagtcctccctctgtggataaaaccagctccccctcttcctttctgccctcacctgcaatgaccacaccttccctgatttcttctaccttaccagaggataagctctcctctcctatgacttcacttctcacctctggcctagtgaagattacagacatattacgtacacgcttggaacctgtgaccagctcacttccaaatttcagcagcacctcagataagatactggccacttctaaagacagtaaagacacaaaggaaatttttccttctataaacacagaagagaccaatgtgaaagccaacaactctggacatgaatcccattcccctgcactggctgactcagagacacccaaagccacaactcaaatggttatcaccaccactgtgggagatccagctccttccacatcaatgccagtgcatggttcctctgagactacaaacattaagagagagccaacatatttcttgactcctagactgagagagaccagtacctctcaggagtccagctttcccacggacacaagttttctactttccaaagtccccactggtactattactgaggtctccagtacaggggtcatctcttctagcaaaatttccaccccagaccatgataagtccacagtgccacctgacaccttcacaggagagatccccagggtcttcacctcctctattaagacaaaatctgcagaaatgacgatcaccacccaagcaagtcctcctgagtctgcatcgcacagtacccttcccttggacacatcaaccacactttcccagggagggactcattcaactgtgactcagggattcccatactcagaggtgaccactctcatgggcatgggtcctgggaatgtgtcatggatgacaactccccctgtggaagaaaccagctctgtgtcttccctgatgtcttcacctgccatgacatccccttctcctgtttcctccacatcaccacagagcatcccctcctctcctcttcctgtgactgcacttcctacttctgttctggtgacaaccacagatgtgttgggcacaacaagcccagagtctgtaaccagttcacctccaaatttgagcagcatcactcatgagagaccggccacttacaaagacactgcacacacagaagccgccatgcatcattccacaaacaccgcagtgaccaatgtagggacttccgggtctggacataaatcacaatcctctgtcctagctgactcagagacatcgaaagccacacctctgatgagtaccacctccaccctgggggacacaagtgtttccacatcaactcctaatatctctcagactaaccaaattcaaacagagccaacagcatccctgagccctagactgagggagagcagcacgtctgagaagaccagctcaacaacagagacaaatactgccttttcttatgtgcccacaggtgctattactcaggcctccagaacagaaatctcctctagcagaacatccatctcagaccttgatcggtccacaatagcacccgacatctccacaggaatgatcaccaggctcttcacctcccccatcatgacaaaatctgcagaaatgaccgtcaccactcaaacaactactcctggggctacatcacagggtatccttccctgggacacatcaaccacacttttccagggagggactcattcaaccgtgtctcagggattcccacactcagagataaccactcttcggagcagaacccctggagatgtgtcatggatgacaactccccctgtggaagaaaccagctctgggttttccctgatgtcaccttccatgacatccccttctcctgtttcctccacatcaccagagagcatcccctcctctcctctccctgtgactgcacttcttacttctgttctggtgacaaccacaaatgtattgggcacaacaagcccagagcccgtaacgagttcacctccaaatttaagcagccccacacaggagagactgaccacttacaaagacactgcgcacacagaagccatgcatgcttccatgcatacaaacactgcagtggccaacgtggggacctccatttctggacatgaatcacaatcttctgtcccagctgattcagacacatccaaagccacatctccaatgggtaccaccttcgccatgggggatacaagtgtttctacatcaactcctgccttctttgagactagaattcagactgaatcaacatcctctttgattcctggattaagggacaccaggacgtctgaggagatcaacactgtgacagagaccagcactgtcctttcagaagtgcccactactactactactgaggtctccaggacagaagttatcacttccagcagaacaaccatctcagggcctgatcattccaaaatgtcaccctacatctccacagaaaccatcaccaggctctccacttttccttttgtaacaggatccacagaaatggccatcaccaaccaaacaggtcctatagggactatctcacaggctacccttaccctggacacatcaagcacagcttcctgggaagggactcactcacctgtgactcagagatttccacactcagaggagaccactactatgagcagaagtactaagggcgtgtcatggcaaagccctccctctgtggaagaaaccagttctccttcttccccagtgcctttacctgcaataacctcacattcatctctttattccgcagtatcaggaagtagccccacttctgctctccctgtgacttcccttctcacctctggcaggaggaagaccatagacatgttggacacacactcagaacttgtgaccagctccttaccaagtgcaagtagcttctcaggtgagatactcacttctgaagcctccacaaatacagagacaattcacttttcagagaacacagcagaaaccaatatggggaccaccaattctatgcataaactacattcctctgtctcaatccactcccagccatccggacacacacctccaaaggttactggatctatgatggaggacgctattgtttccacatcaacacctggttctcctgagactaaaaatgttgacagagactcaacatcccctctgactcctgaactgaaagaggacagcaccgccctggtgatgaactcaactacagagtcaaacactgttttctccagtgtgtccctggatgctgctactgaggtctccagggcagaagtcacctactatgatcctacattcatgccagcttctgctcagtcaacaaagtccccagacatttcacctgaagccagcagcagtcattctaactctcctcccttgacaatatctacacacaagaccatcgccacacaaacaggtccttctggggtgacatctcttggccaactgaccctggacacatcaaccatagccacctcagcaggaactccatcagccagaactcaggattttgtagattcagaaacaaccagtgtcatgaacaatgatctcaatgatgtgttgaagacaagccctttctctgcagaagaagccaactctctctcttctcaggcacctctccttgtgacaacctcaccttctcctgtaacttccacattgcaagagcacagtacctcctctcttgtttctgtgacctcagtacccacccctacactggcgaagatcacagacatggacacaaacttagaacctgtgactcgttcacctcaaaatttaaggaacaccttggccacttcagaagccaccacagatacacacacaatgcatccttctataaacacagcagtggccaatgtggggaccaccagttcaccaaatgaattctattttactgtctcacctgactcagacccatataaagccacatccgcagtagttatcacttccacctcgggggactcaatagtttccacatcaatgcctagatcctctgcgatgaaaaagattgagtctgagacaactttctccctgatatttagactgagggagactagcacctcccagaaaattggctcatcctcagacacaagcacggtctttgacaaagcattcactgctgctactactgaggtctccagaacagaactcacctcctctagcagaacatccatccaaggcactgaaaagcccacaatgtcaccggacacctccacaagatctgtcaccatgctttctacttttgctggcctgacaaaatccgaagaaaggaccattgccacccaaacaggtcctcatagggcgacatcacagggtacccttacctgggacacatcaatcacaacctcacaggcagggacccactcagctatgactcatggattttcacaattagatttgtccactcttacgagtagagttcctgagtacatatcagggacaagcccaccctctgtggaaaaaaccagctcttcctcttcccttctgtctttaccagcaataacctcaccgtcccctgtacctactacattaccagaaagtaggccgtcttctcctgttcatctgacttcactccccacctctggcctagtgaagaccacagatatgctggcatctgtggccagtttacctccaaacttgggcagcacctcacataagataccgactacttcagaagacattaaagatacagagaaaatgtatccttccacaaacatagcagtaaccaatgtggggaccaccacttctgaaaaggaatcttattcgtctgtcccagcctactcagaaccacccaaagtcacctctccaatggttacctctttcaacataagggacaccattgtttccacatccatgcctggctcctctgagattacaaggattgagatggagtcaacattctccctggctcatgggctgaagggaaccagcacctcccaggaccccatcgtatccacagagaaaagtgctgtccttcacaagttgaccactggtgctactgagacctctaggacagaagttgcctcttctagaagaacatccattccaggccctgatcattccacagagtcaccagacatctccactgaagtgatccccagcctgcctatctcccttggcattacagaatcttcaaatatgaccatcatcactcgaacaggtcctcctcttggctctacatcacagggcacatttaccttggacacaccaactacatcctccagggcaggaacacactcgatggcgactcaggaatttccacactcagaaatgaccactgtcatgaacaaggaccctgagattctatcatggacaatccctccttctatagagaaaaccagcttctcctcttccctgatgccttcaccagccatgacttcacctcctgtttcctcaacattaccaaagaccattcacaccactccttctcctatgacctcactgctcacccctagcctagtgatgaccacagacacattgggcacaagcccagaacctacaaccagttcacctccaaatttgagcagtacctcacatgagatactgacaacagatgaagacaccacagctatagaagccatgcatccttccacaagcacagcagcgactaatgtggaaaccaccagttctggacatgggtcacaatcctctgtcctagctgactcagaaaaaaccaaggccacagctccaatggataccacctccaccatggggcatacaactgtttccacatcaatgtctgtttcctctgagactacaaaaattaagagagagtcaacatattccttgactcctggactgagagagaccagcatttcccaaaatgccagcttttccactgacacaagtattgttctttcagaagtccccactggtactactgctgaggtctccaggacagaagtcacctcctctggtagaacatccatccctggcccttctcagtccacagttttgccagaaatatccacaagaacaatgacaaggctctttgcctcgcccaccatgacagaatcagcagaaatgaccatccccactcaaacaggtccttctgggtctacctcacaggatacccttaccttggacacatccaccacaaagtcccaggcaaagactcattcaactttgactcagagatttccacactcagagatgaccactctcatgagcagaggtcctggagatatgtcatggcaaagctctccctctctggaaaatcccagctctctcccttccctgctgtctttacctgccacaacctcacctcctcccatttcctccacattaccagtgactatctcctcctctcctcttcctgtgacttcacttctcacctctagcccggtaacgaccacagacatgttacacacaagcccagaacttgtaaccagttcacctccaaagctgagccacacttcagatgagagactgaccactggcaaggacaccacaaatacagaagctgtgcatccttccacaaacacagcagcgtccaatgtggagattcccagctctggacatgaatccccttcctctgccttagctgactcagagacatccaaagccacatcaccaatgtttattacctccacccaggaggatacaactgttgccatatcaacccctcacttcttggagactagcagaattcagaaagagtcaatttcctccctgagccctaaattgagggagacaggcagttctgtggagacaagctcagccatagagacaagtgctgtcctttctgaagtgtccgttggtgctactactgagatctccaggacagaagtcacctcctctagcagaacatccatctctggttctgctgagtccacaatgttgccagaaatatccaccacaagaaaaatcattaagttccctacttcccccatcctggcagaatcatcagaaatgaccatcaagacccaaacaagtcctcctgggtctacatcagagagtacctttacattagacacatcaaccactccctccttggtaataacccattcgactatgactcagagattgccacactcagagataaccactcttgtgagtagaggtgctggggatgtgccacggcccagctctctccctgtggaagaaacaagccctccatcttcccagctgtctttatctgccatgatctcaccttctcctgtttcttccacattaccagcaagtagccactcctcttctgcttctgtgacttcacttctcacaccaggccaagtgaagactactgaggtgttggacgcaagtgcagaacctgaaaccagttcacctccaagtttgagcagcacctcagttgaaatactggccacctctgaagtcaccacagatacggagaaaattcatcctttctcaaacacggcagtaaccaaagttggaacttccagttctggacatgaatccccttcctctgtcctacctgactcagagacaaccaaagccacatcggcaatgggtaccatctccattatgggggatacaagtgtttctacattaactcctgccttatctaacactaggaaaattcagtcagagccagcttcctcactgaccaccagattgagggagaccagcacctctgaagagaccagcttagccacagaagcaaacactgttctttctaaagtgtccactggtgctactactgaggtctccaggacagaagccatctcctttagcagaacatccatgtcaggccctgagcagtccacaatgtcacaagacatctccataggaaccatccccaggatttctgcctcctctgtcctgacagaatctgcaaaaatgaccatcacaacccaaacaggtccttcggagtctacactagaaagtacccttaatttgaacacagcaaccacaccctcttgggtggaaacccactctatagtaattcagggatttccacacccagagatgaccacttccatgggcagaggtcctggaggtgtgtcatggcctagccctccctttgtgaaagaaaccagccctccatcctccccgctgtctttacctgccgtgacctcacctcatcctgtttccaccacattcctagcacatatccccccctctccccttcctgtgacttcacttctcacctctggcccggcgacaaccacagatatcttgggtacaagcacagaacctggaaccagttcatcttcaagtttgagcaccacctcccatgagagactgaccacttacaaagacactgcacatacagaagccgtgcatccttccacaaacacaggagggaccaatgtggcaaccaccagctctggatataaatcacagtcctctgtcctagctgactcatctccaatgtgtaccacctccaccatgggggatacaagtgttctcacatcaactcctgccttccttgagactaggaggattcagacagagctagcttcctccctgacccctggattgagggagtccagtggctctgaagggaccagctcaggcaccaagatgagcactgtcctctctaaagtgcccactggtgctactactgagatctccaaggaagacgtcacctccatcccaggtcccgctcaatccacaatatcaccagacatctccacaagaaccgtcagctggttctctacatcccctgtcatgacagaatcagcagaaataaccatgaacacccatacaagtcctttaggggccacaacacaaggcaccagtactttggccacgtcaagcacaacctctttgacaatgacacactcaactatatctcaaggattttcacactcacagatgagcactcttatgaggaggggtcctgaggatgtatcatggatgagccctccccttctggaaaaaactagaccttccttttctctgatgtcttcaccagccacaacttcaccttctcctgtttcctccacattaccagagagcatctcttcctctcctcttcctgtgacttcactcctcacgtctggcttggcaaaaactacagatatgttgcacaaaagctcagaacctgtaaccaactcacctgcaaatttgagcagcacctcagttgaaatactggccacctctgaagtcaccacagatacagagaaaactcatccttcttcaaacagaacagtgaccgatgtggggacctccagttctggacatgaatccacttcctttgtcctagctgactcacagacatccaaagtcacatctccaatggttattacctccaccatggaggatacgagtgtctccacatcaactcctggcttttttgagactagcagaattcagacagaaccaacatcctccctgacccttggactgagaaagaccagcagctctgaggggaccagcttagccacagagatgagcactgtcctttctggagtgcccactggtgccactgctgaagtctccaggacagaagtcacctcctctagcagaacatccatctcaggctttgctcagctcacagtgtcaccagagacttccacagaaaccatcaccagactccctacctccagcataatgacagaatcagcagaaatgatgatcaagacacaaacagatcctcctgggtctacaccagagagtactcatactgtggacatatcaacaacacccaactgggtagaaacccactcgactgtgactcagagattttcacactcagagatgaccactcttgtgagcagaagccctggtgatatgttatggcctagtcaatcctctgtggaagaaaccagctctgcctcttccctgctgtctctgcctgccacgacctcaccttctcctgtttcctctacattagtagaggatttcccttccgcttctcttcctgtgacttctcttctcacccctggcctggtgataaccacagacaggatgggcataagcagagaacctggaaccagttccacttcaaatttgagcagcacctcccatgagagactgaccactttggaagacactgtagatacagaagacatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccacattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcatctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagcgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccagtgaagtgatcaccaggctctctacctcccccatcaaggcagaatctacagaaatgaccattaccacccaaacaggttctcctggggctacatcaaggggtacccttaccttggacacttcaacaacttttatgtcagggacccactcaactgcatctcaaggattttcacactcacagatgaccgctcttatgagtagaactcctggagatgtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccaccactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaaaccaagtttctaaccaacccctcctttttgaccccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacagtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccacttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgtcctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggacgataccactgttttcacatcaaatcctgccttctctgagactaggaggattccgacagagccaacattctcattgactcctggattcagggagactagcacctctgaagagaccacctcaatcacagaaacaagtgcagtcctttatggagtgcccactagtgctactactgaagtctccatgacagaaatcatgtcctctaatagaacacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctccctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggatttaggaagacaaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcaacacccattttggataccagaatgacagagagcgttgagctgggaacagtgacaagtgcttatcaagttccttcactctcaacacggttgacaagagaatgcgcatggcgagaagggagaagtgtagttggatggataaaaggaagaatggagagaagagtgaatggaaggaagcaaagatgaagcggaggaaggatagatgcacagaaggaaggatgaaaagaaagaaagatgatggaagacaggattgaaggggatatagattgaaggaaagaaaggtagaaggatgaaatgaagtaaagattgaagaaaagatggatggaaagaagaaaggagggtgcacaaaaaatctcacacttcaccacatatgattcatccatataagaaaaaaccacttgtaccctcaaagctattgaaatacaaacttttaaattaaaattttaaaaagcaagagaaaggaaagaagggaggaaagacaaaaggaagaatgggtgatagaaggaaagaataaaaggaagaaaaaatggaagaatagatgatcagatctagggatgaatgaaaggaaggatggacaaatctataggtaggtggatggatctatggacaggtgtggccacttatggcacatagtcccagctccagttcatactgatggacttgaggagtgtttgtggccaatgaagtggatccatttagacagtgctcttcttctgaatgagatgagttaccccagtttttctccccaccttcatcttcaggaactgatggcattatggaacacatcacaaaaatacccaatgaagcagcacacagaggtaccataagaccagtcaaaggccctcagacatccacttcgcctgccagtcctaaaggtaggtttaactttgcttacctcccagtaatgccactcgtgaccatatttcctcctccagagagacaaaatgtttgtattctttagagagagaattgtgtgtggttgtcataggtttccctgtctgaactgagtctttatctaatggttaccaggcagatgttaccactgtctctttctcctcatggcatgctgagtgagttttgtccaacatcaaatattcacaaatttgtccatattaaccaaattttaaaaatgctcattaaaaacttactatgagctgggcgcagtggctcatgcctgtaatcccaatactttgggaggctgagctgggtggatcaccagaggtcaaaaattcgagaccagtctgaccaaaatggtgaaactccatctctactgaaaatataaaaattagccgggcatggtggcacacaccgtaatcacagctactcaggaggctgaggcaagagagtcacttgaaccacaggaggtagaggctgcagtgagctgagcattgtgccaatgcactccagcctgggtggcagagcaagactccagctcagaaataaataatatattatatatatatatatatgttttatttagatggaatatactatatatatatgtatatatatatgtatgtatatatatatatgtatgtatatatatatatatatatatatatatatatatagagagagagagagagagagagagagagagagacagagtatgtctgagaatgcatcccgatagttctagcaaggtaggaaaaggaagtatcataacagccttgaagtagcctgttgaaacagacagactctcttgtaagagaactcacaaaatctaggattatatctcccatgatgaaaaatttggaactgtacatttttgtttaactgtcacttaaatnnnnnnnnnnnnnnnnnnnnnnnnnnnnnnnnnnnnnnnnnnnnnnnnnnnnnnnnnccaggaggcactgtgcttggcgcctttttaccaacactttgagatggccattgtacttatccccactttatagacgggaaaatggaggtccagcaatattttttaacttaaagagccacccatctctttagagaaagagccagaatcccaggcaggggctatcttattccagagcccaagctctcaaacacatgatacacaatacttaatctctctcaagtcagaggagatccacttaagtatacatccatccacatattcattcattcaatcattcaacaaatattagttgagcacttaccgtatgccaaacagtcaaacgtgaatagctgttacaaatgagactgtgaaggatggtacaacgcagattcagacagtgtgataaggaaatattgagaagcaaagatgagttctggagtgaatttgtaaaggtggatgtgggcttggatttcaataatggcagaacttaaggaatctgatgagaagtgggcacttcaggcagagagaagagcttgaacaaggctcagaggctgacagtgcaggaaacacatgggaagagggaatagagtagcggtcaagaattcacagaggagttataggtgaagatgcaaccaagttacagaccaaggtaagataggggaataccaatcacaatctcttttcccattccagaagcatcccagacacatcctagtaaccgagagacatttctctccctttcctcctgtggagaataaataagctattgcaagtccagtaagtgtaatcattttgttcaaattgtgtgcccattccccaatttacaggactacacacaggagggacaaaaagaatggagaccacaaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctgggagcagaaaccagcacagctcttcccaggacaaccccatctgttttcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtcctggggcagaaaccagttcagctattccaattatgactgtctcacctggtgcagaagatctggtgacctcacaggtcactagttctgggacagacagaaatatgactattccaactttgactctttctcctggtgaaccaaagacgatagcctcattagtcacccatcctgaagcacagacaagttcggccattccaacttcaactatctcgcctgctgtatcacggttggtgacctcaatggtcaccagtttggcggcaaagacaagtacaactaatcgagctctgacaaactcccctggtgaaccagctacaacagtttcattggtcacgcatcctgcacagaccagcccaacagttccctggacaacttccatttttttccatagtaaatcagacaccacaccttcaatgaccaccagtcatggggcagaatccagttcagctgttccaactccaactgtttcaactgaggtaccaggagtagtgacccctttggtcaccagttctagggcagtgatcagtacaactattccaattctgactctttctcctggtgaaccagagaccacaccttcaatggccaccagtcatggggaagaagccagttctgctattccaactccaactgtttcacctggggtaccaggagtggtgacctctctggtcactagttctagggcagtgactagtacaactattccaattctgactttttctcttggtgaaccagagaccacaccttcaatggccaccagtcatgggacagaagctggctcagctgttccaactgttttacctgaggtaccaggaatggtgacctctctggttgctagttctagggcagtaaccagtacaactcttccaactctgactctttctcctggtgaaccagagaccacaccttcaatggccaccagtcatggggcagaagccagctcaactgttccaactgtttcacctgaggtaccaggagtggtgacctctctggtcactagttctagtggagtaaacagtacaagtattccaactctgattctttctcctggtgaactagaaaccacaccttcaatggccaccagtcatggggcagaagccagctcagctgttccaactccaactgtttcacctggggtatcaggagtggtgacccctctggtcactagttccagggcagtgaccagtacaactattccaattctaactctttcttctagtgagccagagaccacaccttcaatggccaccagtcatggggtagaagccagctcagctgttctaactgtttcacctgaggtaccaggaatggtgacctctctggtcactagttctagagcagtaaccagtacaactattccaactctgactatttcttctgatgaaccagagaccacaacttcattggtcacccattctgaggcaaagatgatttcagccattccaactttagctgtctcccctactgtacaagggctggtgacttcactggtcactagttctgggtcagagaccagtgcgttttcaaatctaactgttgcctcaagtcaaccagagaccatagactcatgggtcgctcatcctgggacagaagcaagttctgttgttccaactttgactgtctccactggtgagccgtttacaaatatctcattggtcacccatcctgcagagagtagctcaactcttcccaggacaacctcaaggttttcccacagtgaattagacactatgccttctacagtcaccagtcctgaggcagaatccagctcagccatttcaacaactatttcacctggtataccaggtgtgctgacatcactggtcactagctctgggagagacatcagtgcaacttttccaacagtgcctgagtccccacatgaatcagaggcaacagcctcatgggttactcatcctgcagtcaccagcacaacagttcccaggacaacccctaattattctcatagtgaaccagacaccacaccatcaatagccaccagtcctggggcagaagccacttcagattttccaacaataactgtctcacctgatgtaccagatatggtaacctcacaggtcactagttctgggacagacaccagtataactattccaactctgactctttcttctggtgagccagagaccacaacctcatttatcacctattctgagacacacacaagttcagccattccaactctccctgtctcccctggtgcatcaaagatgctgacctcactggtcatcagttctgggacagacagcactacaactttcccaacactgacggagaccccatatgaaccagagacaacagccatacagctcattcatcctgcagagaccaacacaatggttcccaggacaactcccaagttttcccatagtaagtcagacaccacactcccagtagccatcaccagtcctgggccagaagccagttcagctgtttcaacgacaactatctcacctgatatgtcagatctggtgacctcactggtccctagttctgggacagacaccagtacaaccttcccaacattgagtgagaccccatatgaaccagagactacagccacgtggctcactcatcctgcagaaaccagcacaacggtttctgggacaattcccaacttttcccataggggatcagacactgcaccctcaatggtcaccagtcctggagtagacacgaggtcaggtgttccaactacaaccatcccacccagtataccaggggtagtgacctcacaggtcactagttctgcaacagacactagtacagctattccaactttgactccttctcctggtgaaccagagaccacagcctcatcagctacccatcctgggacacagactggcttcactgttccaattcggactgttccctctagtgagccagatacaatggcttcctgggtcactcatcctccacagaccagcacacctgtttccagaacaacctccagtttttcccatagtagtccagatgccacacctgtaatggccaccagtcctaggacagaagccagttcagctgtactgacaacaatctcacctggtgcaccagagatggtgacttcacagatcactagttctggggcagcaaccagtacaactgttccaactttgactcattctcctggtatgccagagaccacagccttattgagcacccatcccagaacagagacaagtaaaacatttcctgcttcaactgtgtttcctcaagtatcagagaccacagcctcactcaccattagacctggtgcagagactagcacagctctcccaactcagacaacatcctctctcttcaccctacttgtaactggaaccagcagagttgatctaagtccaactgcttcacctggtgtttctgcaaaaacagccccactttccacccatccagggacagaaaccagcacaatgattccaacttcaactctttcccttggtttactagagactacaggcttactggccaccagctcttcagcagagaccagcacgagtactctaactctgactgtttcccctgctgtctctgggctttccagtgcctctataacaactgataagccccaaactgtgacctcctggaacacagaaacctcaccatctgtaacttcagttggacccccagaattttccaggactgtcacaggcaccactatgaccttgataccatcagagatgccaacaccacctaaaaccagtcatggagaaggagtgagtccaaccactatcttgagaactacaatggttgaagccactaatttagctaccacaggttccagtcccactgtggccaagacaacaaccaccttcaatacactggctggaagcctctttactcctctgaccacacctgggatgtccaccttggcctctgagagtgtgacctcaagaacaagtaagaataacttttttattgtggtaaaatataaatactataaaaattgccattctaaacattttaattgtacaactcagcagtactaatacattcacattgttgtgcaaccctcaccactatctgttttcaaaactttttttatcaccccaaacaggactgaaggaataatttcccattccccattctccctagtgcagtggtgcaatctcggctcaccacaacctctgaacctctgtctcctgggttcaagcaattctcctgcatcagcctcctgagtagttgggactacaggtgcacgccaccgtgcctggctaatttttgtatttttagtacagacagggttttaccatgttggtcaggctggtctcaaactcctgacctcaggtggtccacacgccttggcctcccaaagtgctgggattacaagtgtgagacactgtgcccggccatatctgttagatcttactaatcctgtcaagaggattcagtgtccttttttttttttctttcttttttttgatagagtctccctctggcacccaggctggagtgcagtggtacggtcttggctcactgcagcctccacctcccagactgaagcgattctcctgcctcagcctcccgaatagctgggactacaggcgcgtgccaccacgcccagctaatttttgcatttttagtagagatgggatttcactatgttggccaggctggtctcaaactcctgatctcaagtgatccgcccaagggcctcccaaagtactgggattacaggtaggagccacctcacctggccctattttcggaatggatttttttttaatgtttaaaatgtcacctaagattattgtgaagatcaaataagataaaatcctaataacccaagtaaaccacagggctccacttggaccagtctcagaagtttcaagaaaatcagtcagaccatcaaatgtaaaataagtctaaattttctttgcactattcacagagtgccaaagaggatctaattcatgtttcagaacataccctacttactaaaatccccttttcctcatttcttctcattctgcaactttatcatctcctgcggaccccctagcctctcccctccccatagtcagtctctctctctctctttccctcccctcttattatctcaatttcacacgaaagaattccagaaactatactgccaaaagtctttcctgtctttgaaaagttgggaaagaggagaaactcagacagcaatgacaaaattatacgtaatggatgaaggaaacacaaataaggctggaaacagaaaattttgtccccatcatttatttaatgaaggtggcagtattccagccacatagtgaacccccacaataagaaggggcctctggcgattgattattgtcattgttgttaatgataatgagggtgaggatatcatgagcatcagtgtaggaggcagttaactaataagaccaagctgttggctgggcgtgctggttcacacctgcagtcccagcactttgggaggccaaagtgggtggatcacttgaggtcaggagttcaagactagcctggccaacatggtgaaacctggtctctaccaaaaatacaaaaattagtcaggtgtggtggcgtgtgcctgtaatgacaactacttgggaggctgaggcaggagaatcacttgaacctgggaggcggaggctgcagtgagatgagcttgaaccactgcactccagcccgggcaacagagagagactcttgtctcaaaaaacaaaacaaacaaacaaaaactaaaccaaacaaaaaaagactagctgttattcatttatttatttatttatttagagacggagtctcgctctgtcacccaggctggagtgcagcggcacaatcttggctcactgcaacctctgcctcccaggttcatgtgattctcccgcctcagcctccccagctgttgttattcatgaatgaacctcagagaaagcacacaggagggttggtgcacctgtgttttgagttctacccctccttcctctcttaacttcctcctgtcttctcactctgattcgttcttccttcctctccctctctctctgcaggttataaccatcggtcctggatctccaccaccagcagtgagtaaacatggccctgaagtccctatgccctgggaattcttcctccctaagcctgccttccaggaggaaagtatcccccattccctaggttctcatccccacagaaactccagaatagcaaaagtctcaggctgagccaaggcacagatgccagtgctcaccaagagtcctattctcccctcgctaaatgataggacccaacaaacccgattcacgctgcgttttctttcagctccgatgacctccatgttctctccaaggcctctcgtatctgtgagccccacccccagcgctacaggtaggaatctggcttccagctcccatgaaacgtcggctgccattcagtggctgattaattgctgtgtggtctgagtcctgatgcccaccaagtctcagcgtgttcccctctgtccaatctcatccaacaatttaagctaatgcttgtttaatgatgtcctcactataccaccttggacactttctttttgcctggatttaaagcttccatttctttccttccttccttcttttcttccttccttccttccttccttccttccttccttccttccttccttccttccttccttcctccttccttccttcctttcttcctttcttcctgtctttttctttctttccttcttttggcagagtctcactctgtcgcccaggctggagtgcaatggtgcaatctcggttcactgcaacctctgcctcccaggttcaagcgattctcatgccacatgccactatgcctggctaatttttgtttttttgttttttggggggttttttgagacagagtctcagtctgttgcccaagctggagtgcagtggcatgatctcgggtcactgcaacctccttctcccaggttcaagcgattttcctgcctcagcctcctgagtagctggaactacaggcacgcaccatcacaccggctaattttttgtgtttttagtagagacgacggttttgcaatgtgggccaggcttgtctcgaactcctgacctcaagtgatcctccagcctcggcctctcaaagtgctgggattacaagtgtgagccactgcaccaggccaaaaacttgtatttcaatagtcattgaggctgggtgcagtggctcacgcctgtaatcccagcactttgggaggctgaggccagtggatcatgaggtcaggagatcaagaccaccctggctaacacagtgaaaccccatctctactaaaaatacacacaaaaattagccgggcatggtggcaagatgcctgtagtcccagctactcaggaggctgaggcaggagaatggcgtgaacctgggaggcagagcttgcagtgagcggagatcgcaccgctgcactccagcctgggcaacagagagcgactctgtctcaaaaaaaaaaatatatatatatatatatatatattcattgagaccgactctgacttaaaagcagtaatgaatggtgtaggttttggtaaattacaggtcttgctttaagtcctggtcctctcttttgctcactgtgtggccccggaagagccatgtaacctctccaggcttcagtgtccatttttagaacggagtaagtgaataagctgtgtccaatcatctctggccatatcagcttcattttttttttcctccagggtccaaacatccctccaccctcagagtctttgcacctggtgttcttgtccttcaaatctcagcttggatcaccctttataaagtagcatttcccccgtatacgcatcttgcacacagccaatctctattctacctctatgctcacttccttcctggcaattattactacagctgggcccttgaacagcatgagggttcagggtgctgacccctatgcattcaaaaatccacatataacttttttttttttgagatggagtttcacacttgttgcccaggctggagtgcagtggcgccatcttggctcactgcaaactctgcctcctgggttcaagtgattctcctgcctcagcctcctgagtagctgggattacaggcatgtgccaccatgcccagctaattttgtatttttagtagagatgaggtttctccatgttcgccaggctgctcttgaactcctgacttcaggtgatccgcctgccttggcctcccaaagtgctgggattacaggcatgagccatgatgcccggccatttgctaatggcatctagtaagtagaggccagagatgttgcaaaacatccaacaatgcacaaagcagcctcctatcaaaacacattatccagaccaaaatgtcaatagggctgaggttgagcatctgctgtacacagattccaagttctggtacaaatctcgtagttctctgagggctcatctttcaatgcctagcacatcaaaggaggccaatttcctcttccctttcacctcctggtatgaaatgtttcctcctccaccttgatcctgtaagagcccagctggagtttgcagacgacggggaaagaaatgggtgagggagggtcctatggttgagtctccgcagtgggccctgggtgcccagttcaccctcctccccttcattttctccatcatgacaactcaaggcaaattctcagtttccatgggccagtggaatccactgacttcatgaaataaccccaccctgagcaaatacccctcaaataataactgtttacacaacatcagtggcaacaatgacccaagcagcaatgccaccaccagaatagcaaccataacagcagctcattttcatcaaaaggaaactgtagggccaggcacagtggctcacacctatattcccagcattttgggaggctgaggcaggcagatcacctgaggtcaggagttcaagaccagcccagccaacatggtgaaaccccatctctactaaaaatacaaaaactagccaggcttggtggcatgtgcctgtaatcctagctactcgggaggctgaggcaggagaattgcttgaacctgggaggcagaggttgcagtgagctgagattgtgccactgcactccagcctgggcgacagagcaagactccgtctgaaaaaaaaaaaaaaaggaattgtgccaggaattgtgatgagaactttatatgcattatctcctattaatattacccaaacctccgtgagttactatactcatttctacagagagcatttatgcatccagggaggaagtaattagcccagaattactcagttatgacacaggacagtatgaaaactccaaccgaagattggagactcatgaaaactccaggctcctaactacaagacatcactgtggatcgtccaaatagagcaagccccaatctcaggacaggaatgaggcatgaatggcctctatgctaatgatctaacctaatgctgaatttgttacttcccttctgaatccacttggagatttcctttatatctgacttgaaatagaggatatatactcctctatccttgacataggagataatacacagaaagtatttcattgtagtatcaagtacacatcctgttctgtgtccataggattatgactaatttagggcatggcttaacagtgtggtactattgaatgacagacagatgtctgttttgttggatgcaggacaagccatgtaacctccccagactttagtgtcccctctgtggaatggaataaaaatactacgtgggattgttctgataatcaaatgagataattcaggaacaacccagataaataacagggctgccctgggttctgtctttccttgtatctctcacagagcctcaaaggagatgcaatccatgacctagagaaacactcaggacaaattctcttttccccagttcctttcttgctccaatggcaacaccacccctctcatcctgaagtctcttgtttttaccaccacacctattttgccaaattttctccaatattccaaaccatatgaaacctttctttctttcttttctttccttcctttccttctttctttcttttttctcttcttttcttttctttttgagacatggtctcactctgttgcacaggctggagtgcaatggcacgatctttgctcactgcaacctccgcctcccaggttcaagagattctcttgcctcagcctcctgagtagctgggattacaggcgcccaccgccacgccacgctaatttttgtgttcttagtggagacggggtttcgccatgttggccaggctggtcttgaactcctgacctcaagtgatttgcccatctcggtctcccaaagtgctaggattacaggcgtgagccaccaagcccggccccatatgaaccgtttctatccctcatttctctgtacttttacctaaaaacaccactcccttcacccatcacatttttgtcaattctacatcacacacacacacacacacacacacacacacacagagaaagtaagttggaaaaaaattatactatcatgaaattttgtgaaaggaggtaagctgagagagtaagaatcaaactaaattatctttatgggtagaaagcacactcatccatacatgtgtctttccacccttgtaatgtatttattattattgtttgtatatactagattcccaataaatagggacagctattatggtatttttatttcaggaataataatagtgatgatttccaccattattgtcaaaggacaaagcacaaaatatgtaccaaataaaatatagccattatcctttattcacaaaagatcttggccccacctcttctcaatgaaatgtccatgacttgttcaactttggccactctgggctgagagatggaggttcccttgcgagctgaagtcacacatcgaaggtggaagcccctcccctccctctggctggctgagggatagcccagatgggctcatcatgaaagtttcccattatttccatttctggatctaccatcttcccctcccctacctctcacccatcataattgtccttctttactctttcctccctatctgcaggttataaccgtcggtactggacccctgccaccagcagtgagtattcaaacctgtgatattccaatgcccttgggacccttcctccccaaggtgcattcctcagaagagaaactgatcattctccctccctacgtgcccagccacagcctcagagcagcccctaacccgtcaaggtcttggtgtgagtcaagatagaagtccaaattccaatgagcagttcctgtcccatattcctttaggaagacacccaatcatttctccatgttctttttttctcagctccagtgacttctacattctccccagggatttccacatcctccatccccagctccacaggtaggaagctcctctctggcatctatgaaatttaacactgcatggtctgttccctgctgaccacccagactcagcctgttccactcgccctctcactctctctctctctcttttttttttttttttttttttttttttacggagtcttgctctgtcacccaggctggagtggaatggtgtgatctcggctcactgcaaccttcgcctcccaggttcacgtgattctcctgcctcagcctccggagtagctgggattacaggtgcacaccaccatgcctggctaattttttgtatttttagtagagacggggtttcaccatgttggccaggctggtcttgaactcctgacctcaagtgatctacccaccttggcctcccaaagtgctgggattataggcatgagccaccacgccaggcccactctctaaattttgaccaccctgccttgagtggtcttctagcaccctaacctctgtctaacctcgagagctttgcactagcgattcctggggaccagctatggttggtatcttctcaactttctaatttttttaaaattattattattattattattattttaaatggagtctcgctctgtcacccaggctggagtgcagtggcaccatctcggctcattgcaacctctacctcccgggttcatgcaattttcctgcctcagccagaaattttctcagtggtcgagattgtgccactgcactccagcctgggcaatggagctaggctccatctcaaaaaaaaaaaaaaaaagacggaggtcgggcattcctaacccttaaccctgccttgtgattctggagttatgagatagaacctggtgtcccgtaattaaaattccgccttcaggccttatgttttgtgagtcacaacactgcaaactttttacatgctgtagacaggatgttcactctccacttcctcactgctctgctctaatcaattcaaccatttatgtgacatgcctaacccctctgggcttgtacgtatgtaacatgtattacaaagcaagtcattccatgatcaatgctgtcactttttctaggtgctttcaaaatttgttcttcatcattgattttcagtagtttgattacgatgtgtctgggcatggttttctttgagtttatcctgcttaaagtgttctcagcttcttgagtctcaaagtgtttattttctgctctgattctttctccccttcggacctccaatgaaatgatgttgcccgaagagaccctgaggttctgttcattttgttatttatcaatcttttttcctctccgaatttcaggtttaataattttttttttttttttgagacggagtctcgctctgtcgcccaggctggagtgcagtggcgcgatctcggctcaccgcaagctccgccccctgggttcacgccattctcctgcctcagcctccggagtagctgggattacaggcacccgccaccatgcccggctaattttttgtattttttagtagagacggggtttcaccgtattagccaggatggtctcaatctcctgacctcgtgatccgcccgcctcagcctcctaaagagctgggattacaggcgtgagccactgcgcccggcccaggtttaataatttttatagaatattttcacaatcaccaagccttttctctaccagctccattctgcccatccattgaattctttttatctcagttactttatgtttcagttcgaaagtttctacttggttagatagatagatgttatatcatatattatatgttatataaaaatatatttatggttatacatataacatatatgttatatatagttatttatatagccataactatatatagccatatatatagttatatataaccatatatatagttaccatatagtaaccacatatataaaacatatatatatagtgtctctctatatatagttatatatatagtttctatatctgtaactatatatagttatatatgtatgtttctctgtatataaatatatatatttctatatatatagttatacacattatatatataactgggagatgttggtaaaggatggcgtgaggaaacctggagcagtcatggtaatcctcgctctgctccgaactcctcaagagcaggagaagggtcctcctcattctccagccatgttgactttgagcaatttactcatcctctcagtacctcagtttcctcacctgccaattgaggataataatatttcataaattgtttgcaaatgttatatgcaactctacgtaagaacacctagcacaggggctaccagggaatttggtttaacaaatatttatcaggcacctattctgggctgggcaggggggataagatgttgactaagtcaaatgcagtccctcccctcaccaagtttacagtgtattgggcaagactgaaatggaacaagcaattacaattgacaataaaagacaaccaagttattgagcacttactatatggcatgccatatgctatgtattttttttatttttaacttttcattttgaaataaataataaatataaagtaaataataatataaataaataataaataacttttcattttgaaataaataataaataaattcaggagatgttgcgaaaatagtgtagcattcccctgtatccttcacccagtttctccccaatggctacatcttacataactctaatacaatatcaaaagcaggaaactgacattgttaaaatccattttactggttttacacgcgtgtgtgcatatgtgagcttgtgtatgtgcgtgtgtgtgcaggcatgtgtgtgcatgcacgcctgtgtgtgcatatgtgcatgtgtgcatgcgtgtgtgcatgtgtgcatgtgtgtgtgcatgcgtgcgtgcgtgcgtgcatctgtgtgcatgtatgcacatgtgtgtgtgtctgtgcacgtgtgtgcatgcatgtgtgtgtgcgtgtgtgttggtagccctatgcaatttttatcacatgggcatagccctataatcaccaccaccatcaagattcagaactgttccattcccccaaagattcccctcatgctagccttcgtaatcatgcccactgagcccaacactattgcatagaatagctattctactctccatctccatctctgtctctacaattttcttttgaagatgttatataaatggaaatgtacaacatgtcacctttgaaattggcttcttttccactcagtgtaatgccctggagatgtgctctttttaacagtcatgtaaccttcctaatttccctccaaaatatcattatgcccctcgccgccttttttttttttttttttttttgagacagagtctcgctctgttgcccaggctggagtgcagtggtataatctcagctcactgcagcctccgtctcccgggttcaagggattcccctgcctcagcctcccaagtagccaggattacaagtgcatgccaccacgcctggctaatttttgtatttttagtcgagacggggtttcattgtgttggccaggctggtctcgaattcctgacctcaagtgatctgcccgccttggcctcccaaagtgctgggattacaggtgtgagccaccgcgcccgacccatattgcccattgtattacagcggaagaaactgaggtatggacaggtaacatgtccatggtcacttggctggtgaggggcagagaggagatttgaaaccaaatctgactcactagtgtggccgtaaccatggtaactatgtctctctaccatgtggtctcctctttattaaaggaagggcaagttctgggagttttgggagttttgggcttgagtggggaagggtagccaagtaaagcaggtgagagaaggtctgctttaaggactgctgtttgatttttattgttgttgttcagtgttcaatgggattgagttgactcttttttcccttcttgttccccaaagcatgagactgttccggtccttttcccttttaacttctcagctagagtttgttagggcgggtatgggcacctggcagagtctgagacctcagcttccagtaggcacacgttctgacccaatacacctaccctggtcccctaacctgcttctggtcccctaacctgcttctgggcccaggtaatgcattttaggaacatcccacttttctccttacctggctttccattatccgtccaaactaaagcacccacctgtctgcttcagactcttgcttcaagcactccgtctgggtcctcagaaattgacttacagtcagttcagatctgactcaggcgtggccttcttttctccttccttgc

SEQ ID NO: 312 - DNA, 42348 bp, Homo sapiens
  misc_feature (1)..(130): Exon R1
  misc_feature (442)..(510): Exon R2
  misc_feature (2126)..(2250): n is a, c, g, or t
  misc_feature (5479)..(5652): Exon R3
  misc_feature (6301)..(6334): Exon R4
  misc_feature (6593)..(6657): Exon R5
  misc_feature (7558)..(7683): Exon R1
  misc_feature (8216)..(8284): Exon R2
  misc_feature (8877)..(9050): Exon R3
  misc_feature (9380)..(9413): Exon R4
  misc_feature (9675)..(9739): Exon R5
  misc_feature (10082)..(10200): n is a, c, g, or t
  misc_feature (10201)..(10291): Exon R1
  misc_feature (10524)..(10592): Exon R2
  misc_feature (11200)..(11373): Exon R3
  misc_feature (11722)..(11755): Exon R4
  misc_feature (12016)..(12036): Exon R5
  misc_feature (12037)..(12150): n is a, c, g, or t
  misc_feature (12169)..(12295): Exon R1
  misc_feature (12532)..(12600): Exon R2
  misc_feature (13219)..(13392): Exon R3
  misc_feature (13723)..(13756): Exon R4
  misc_feature (14016)..(14077): Exon R5
  misc_feature (15001)..(15126): Exon R1
  misc_feature (15367)..(15435): Exon R2
  misc_feature (15475)..(15601): n is a, c, g, or t
  misc_feature (15648)..(15773): Exon R1
  misc_feature (16002)..(16070): Exon R2
  misc_feature (16653)..(16826): Exon R3
  misc_feature (17158)..(17191): Exon R4
  misc_feature (17453)..(17517): Exon R5
  misc_feature (17866)..(18531): n is a, c, g, or t
  misc_feature (18532)..(18657): Exon R1
  misc_feature (18658)..(18887): n is a, c, g, or t
  misc_feature (18888)..(18956): Exon R2
  misc_feature (18957)..(18995): n is a, c, g, or t
  misc_feature (19633)..(19806): Exon R3
  misc_feature (20093)..(20140): n is a, c, g, or t
  misc_feature (20141)..(20176): Exon R4
  misc_feature (20177)..(20386): n is a, c, g, or t
  misc_feature (20387)..(20449): Exon R5
  misc_feature (20450)..(20483): n is a, c, g, or t
  misc_feature (21609)..(21731): Exon R1
  misc_feature (21940)..(22008): Exon R2
  misc_feature (22605)..(22778): Exon R3
  misc_feature (23109)..(23142): Exon R4
  misc_feature (24607)..(24700): n is a, c, g, or t
  misc_feature (29046)..(29168): Exon R1
  misc_feature (29266)..(29334): Exon R2
  misc_feature (30368)..(30450): n is a, c, g, or t
  misc_feature (33917)..(34090): Exon R3
  misc_feature (35192)..(35259): n is a, c, g, or t
  misc_feature (36702)..(36734): Exon R4
  misc_feature (38270)..(38320): Exon R5
  misc_feature (39104)..(39224): Exon R1
  misc_feature (39315)..(39383): Exon R2
  misc_feature (39532)..(39705): Exon R3
  misc_feature (41862)..(41992): Exon R4
agcagccacagtcccattcatggtgccattcaccctcaacttcaccatcaccaacctgcagtacgaggaggacatgcggcaccctggttccaggaagttcaacgccacagagagagaactgcagggtctggtgagagccccgcccaccgtactcctccctcgcccacttagacaaaccagcccacctcacactgcctcgcccactgatgccagccacgcccacctcatccaaccccagacacctttccctgccccacccactgattttagccaagcccacctcaccccacccagcctactgatgccagccacgcccacctttccctgccccgcccactgatttcagccacgcccacctcaccctggtccacccctccaatgccccactcttcctggcttcccgcagctgttgtttctcacctcccctctccttccttgcagctcaaacccttgttcaggaatagcagtctggaatacctctattcaggctgcagactagcctcactcaggtgagacgctccttaagaaaaacacagcccaacaggtgaatatgaccctagtctctgggctccctgactctgttcatacttggaacaactattgcccatggatactaagcatcaccaccagcagcagcagataactattcctaagacccaaggcactgcattatgtactttatatttaatgcctcatcagtgcttgcaacagcctcatgaagcaggagcagaaggggaaactgaggcccagattaagtggcttgtgccaggacacacaaagcaactgcagcacttcaggttctatatccaaactcctatcccttaggtggcacttcctcctctgcccccattatgaacttgcagcatgtggaaaaccccaatctgacttccctctaagggaacttgcccagagaatctaagaggggaggaaaggaaggcgttcagcccttacaggcaggaggtcagctcctgagtggctcagatgcagccacagagggcctggccggtctgagggtgactgagaggcaccgagggcactgtccctgagtgctggaaagggcaggtcttttagggtagacagcggttgatatcatttcctgcctggcattctcaccttccacacctctctcacagaatctccaagtgtggctctcccaagagagagtgtcagtcatctacctccagcttcctttccttcccagggggaagaggggacaggggggccctagtggctaagagcattggtgaactcaggcagacctcagttctgaaccaacccagctctgccatttactatctgtgactctgagcaagtgcctgaagccttctgtgccctatttcctgacatattatatatataaaatacatatattatatatagacatattttatatacatattgaggcatattttataaacatgtttatagacacatttttatatgcatatgttatatacgtatataacatatgttatatataatgtatatattatacatattgttatattgtatacatgttatatatgttatagcatatatagtacaagttatatataacacatacattatgttacatataatgtatatgttatatatgatatattatatataattatatattatataaaactgttatatataattatatataatatatagttgttatatataattatataattgttatatattatatacaacatataacatacattatatattgttatatataatataatatatacatatataacatatgtataacttttatgttatacataatgtatataacatatatgtgtatgtgtgatgtacataacatatctgacattaacatataacatatgatataacaatattatatgttataacataatatatgttataatataacaatattatatgttataacttatactgtcatatgtaacatatacataatattttataaatcagtttaatatacattatgttacatataatgtatgttatatatgatatattatatataattatattatacataattgttatatataatgcatacattgtatttgttacgtattatatgcaacatatggggatcctctagagtcggaccagcggcagcagctgcctgccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatacatacataacatatgtataacttatatgttatatataagtatataacatatatgtgtatgtgatgtatataacatatctgacattaacatataacatatgttataatatgacatattatatatattacatataacgtatatcatgtataatataatgtgtatatataatatattaaagtatataagtataaatacatgtaatatttaaatatatattatatatagtatacatgtggatacatacaacttctacatatacctagtatatattctatatataaacagtccatgaattacaatgattcaacttatgatttttcaaactttgtgataatgccatagcaatatgcattcagtagaaagcataccttcaacacccatgcaaccattctgtcattcactttcagtacaatattcaataaattatatgagatattcaacagtttattataaaataggctttgtgttaggtgattttgcccacatgtaggctaatgtaagggttcagagcatgtttaaggtaggataggctaacctatcatgttctgtaggttaggtatagtcgatttttatttttatttttatttttgagacagagtcttgctctgtcacccagactggaatgcactggtgcgatcatagctcactgcagccttgaactcctgggctcaagtgatcctcctacctcagcctcctgagtagctgggactacaggtgtgtgccaccacacctggctattttttttttaatttttttttttttgtggagaggagggtcttgccatgttgcccaggtggccttgaactcctgggctcaaggaatcctcccaccttggcctcccaaaatcctgggattacaggtgtgagccatcacgcccggctacagggcatttttgacttatgacattttcagttcacaatggatttgtcagggctgggcatgatggctcacacctgtcatcccagcactttgggaggctgaggcaggtggatcacttgaggccaggagtttgagaccaggctgtccaaatggcaaaatcttgtctctactaaaaatacaaaaattagccaggcgtggtgtgacaactgtagttccagctactcgggagactgaagcgtgagaatcacttgaacttaggagatggaagttacagtgagtcaagatcacaccaccgcactccagcctggatgacagagcaagactcttgtctccaaaaaacaaaaaacaggctgggtgcatggctcatgcctgtaatcccagcagtttgggaagctgaggcaggtttatcacctgaggtcagtagttcacgatcagcttggcaaacatggagaaaacccatctctactaaaaatacaaaaattagctggatgtggtggtgggtacctgtagtcccagctactcgggaggctgaggcaggagaatggattgaacctgggaggcagaggttgcagtgagccaagatcacaccattgaactccagcctgggcaacagagtgagactccatctccaaaaacaaaagaaagcaaaaacaaaaaaataaaataaaaaacctgtgtttatcaggacataataccatcatgagtcaagaagcatctaaatgtacatggtagttatataaaaatagttatatagttatatacaatagttatatataaaccagtttaatatatgttaagtagaggtatatggtagttatataaaaaatagttatataatagttatagagttatataattatataaaatagttatatataaaccagtttaatatatgttaggtagaggtataataatatatattgtatatactatataatatagtaatgtataaaatgcaaaacgatatcatatatttctatattaagtttatatttacagatctacattttatatattttatgttatatacaattgtgttatacataatataattagtatagtactgacttggggaattgagcagtaccaacccatagggatgtttgaggatgaaaatatgtgattatgaatacaaaatgctgggcctgctgcataggaagtatttaataaatggtagttgttactataaagtcgttcctactatagagctactcacaacctgggacatagggaaagagcccgtttccctctaatcactcaatagtgggtggctaggtaggtgagtccacatcctgtggccgggaacaggtgctgagacatgaagaccttctgactgcatgttggaccagccacagtttcagacggaccagccaaaaagggcattttccccaagccatttagctcccttgagtctcataacaaatctcctagaccctgctggtccataggatctagagaggatgacttgaaccttctgatcccaccatttgaaaacgccatgccatgggcaccagtaggagggccactgctacgtgcaccagtacaagggccactgccatggattacagattaaccctaagtatagctgtcgcacacctagtacttcaggaggcttattcggggccatgcagatccctggcattattatcctaggatcctacaccaagcaaagcaggagctgcccctcctcataaacccataagccctcctcttgagcaaagcagctgggaaggccagaagttattcaagctcccctctgccccggttccaaagacagacagctcaagcctacatgcagcaaaccctataaaagtgtcacctcttggcatttctgccatggtaatgctttctgcttccactaataatcctagtaatttgtttatggtgggcatctctctgatgagaaccacattcttttttttttttttttttttttttgagatagagtctcactctgttgcccagactggagtgcagtggcgcgatctcggctcactgtaacctttggctcctaggttcaagcaattctcctgcctcagcctcccaagtagctgggactgcaggcacgtaccaccatgcccagctaatttttgtatttttagttgagacggggtttcaccatgttagccaggatggtctcaatctcttgacctcatgatccacctgccttggcctcccaaagtgttgggattacaggcatgagccaccatgcctagcctgagagccacattcttgttaaccacaattttctcagagtctgcattaggggttgacaaagagtggaaaggaaggacaaaaggatggagaggtggatggactaagcatatgtaggttcttacccaggccagagaaggatagctcagccacggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtgagcagctgtgatgtggttggaggctcttcctccttgctgagcagcctgtaatcactggcttgaggtcacactcactgtcaggcaattgaaaatttggtcctgtgctctacatgggatgactaatttccggacttcatggtatctttttttttttttttttttttttgagatggagtctcgctctgtcaccaggctgaggtgcagtggcatgatctcagctcactgcaacctccgcctcccggattcaagcaattctcctgcctcagcctcctgagtagctgggactacaggtgcatgccaccacacccagctaatttttgtatttttagtagagacagggtttcaccatgttggtcaggatggtctcaatctcttgaccttctactccaccttgccttggcctcccaaagtactgggattacaggcttgagccaccacacctggccaggacttcatggtttcttcatcatcatggaatgaattccatcagggcattcttccctgatgtgagggcactgataggaaatctttaatggtccctgctgcatgaaactgcttccattgcaccagggtagccctgacccctatttggtcccccacatctccttgtaacttacccacactcctccctccttctctgtgcaggtttcacccatcgaagctctatgcccaccaccagcagtgagtattcaactcatgtccacatgcccatgatcctacaccaagcaaagcaggagctgcccctcctcataaacccataagtcctcctcttgagcaaagtagctgggaaggcagaagttattcaagctcccctctgccccagtttcaaagacagactcagctcaagcccacatgcagcaaaccctataaaagtctcacctcttggcatttctgccatggtaatgctttctgctctcactaatgaggacttctcctcagctcctgggacctccacagtggatgtgggaacctcagggactccatcctccagccccagccccacgagtaagtaccagtcaatggcatctctattagagcatgctatctctgtcatttttactcagatgaagatggaaaatcatagcaaatctactgatagtgagtggaccaacgaaatttgttggccacctagtgtgtaccagatcctagagatacaggagggaaaacaaaaccaatacaaaatttctgctctcagtgagcttgtattcttgtcatgatgatgatgttggtggtggtgctgttgatgacgatgatgatgatgatgatgatgatgatgctggtgatactgttgatggtgatagtgatgttgatgacaatgatgatgatgatgatgttgaagaaaatgatgctggtgatggtggtgggggttattatggtaataatgatatgttgagtgtgacgatgatggtggtggtgttgatgatgatgatgattattatgctagtgacattgatgatggtaatggtgatatcaacgacagtgacaatgatggtgatgaggatgatgtcggtgatggtggtggggttatgatggtaatgatatgttgaatgtgatgatggtgatgatgatatttgtggttcatgatggggattgtcatggtggtgctggtggtacttgtgatgacaataatgataataatgatgacaatgatagtgatgatggtgatggtgataataaagataacagatatcaccttacaatattgagcactaaatatgtaccaagagctatgctcagtatctaactactattatataatctactttagaaaatgaattgtatcatagataagaaaggcgtggaaaatatttattatgtcactcaatttaattgctgcatatggttattacaaagtgctattctctctactttgaacataatgtttatttcacactcccactatagctgctggccctctcctgatgccgttcaccctcaacttcaccatcaccaacctgcagtacgaggaggacatgcgtcgcactggctccaggaagttcaacaccatggagagtgtcctgcagggtctggttagtgtcctgccctccacactctgccctgctcatgatacccagtccctcttacatcatccatgccagggcaatggaagaatatcaaacccaactcacttttgccccaagagatgcaagcctcagccaggagcggtggctcacgcctgtaataccagcatttgggaggccaaggcgggtggatcacctgaggtcaggagtttgtgaccagcctggccaacatagtgaaacctcatccctactaaaatacaaaaattagccaagcatggtggtgcatgcctgtaatcccagctacttgggagggtgaggcaagagaatcacttgaatcaaggaggcagaggttgcagtgagtcaagatcatgccactttactccagcctaggcaaaaaagcgaaactccatctcacaaaaaaaagaaaaaaagagagagatgcaagcctcccccaccaaggccagccctgcccacctcacttctgcctggctcttacataaaacttagccctcctactcactgccctctccctcctccacagctcaagcccttgttcaagaacaccagtgttggccctctgtactctggctgcagattgaccttgctcaggtgagaacttagaatttccagcctggctgccccacttgtactcactccaaaagactttgcactgcttccttgctgcacttcctagggatatcctcaccaaaggtggaattcaggagtcacaggcttcaggatcagtgtgtttcctgacagtaacacccctacactccacctcaacagagagaatctgcatggcccatcatcaggattgagcctctccctttatcatccctctgaattccctccattccctgtgcctccctttcctttacatgttaaattctgtccccaggatttctttcaggacaatcatgccttatccacgtgatttcatcctcatttcgagctcttcactgggctcaagtccggctccccgtcccgtccatgaaagtgtcagtttcatcttgtcactgtatccgtgactccactcacagtcctcagcaagccaatagtccatgcactaagagtcgatgtggcttctcacctctttcccaggtttctcatttctctggtccttgctgtccttccctcagcaatcgcaagacccttcctagataaacttttcattgtgatttttcccactgaccctccccaggcccgagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtgagtggctgtgatgtggttgaaatctcttcccccttgctgggcagcctctaatctctaactagagatcacactccctgcctggcctttgaaaattctgtcatgtgctctacatgggatgactaaggtctggacttcatggtttccttaccatcatggactgtgttccctcagggcattctttcctgatgtgaggatgctgatagaaaatcttcaattgtccctgtaccatgaaactcggttcattgcaccagggtagcattgacctccatttggtcccccacctctccttgtctcttacccactctcctccctccttctctatgcaggtttcacccatcagagctctgtgtccaccaccagcagtgagtattcaactcatatccacatgcctcggttcctacaccaagaggagcaggagctggcccctcctcataaacccattaagtcctcttcataagcaaaggatttaggagggcagaagttatttaagtgtccctctgcccagctcaagagaccgacccagctcaagctacacatgcaacaaaccccataaatagtctcccctcttgccatttctgccaagagagtgctttatgctttcactgatgagaacttttcctcagctcctgggacctccacagtggatctcagaacctcagggactccatcctccctctccagccccacaagtaagtatcagtcaatgacatctctatgagagcatacctgattagtgtaaacatctctgtcattttcactcaaataaagatggaaaatcatagtaaatctagtgatactgagtggacaaatttgtttgtttgttttttctcatccttttcactttttttattatactttaagttttagggtacatgtgcacaatgtgcagtttagttacacatgtatacatgtgccatgctggtgtgctgcacccatttgctcgtcatttagcattaagtatatgtcctatgcgatccaagcccacgcgccgcaccacgtgcaacagtttcacagattggatggtccgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaccatcaccaacctgcagtatgaggaggacatgcatcgccctggatctaggaagttcaacaccacagagagggtcctgcagggtctggttagcaccctgccctcttcactctcccccgccctggatgccgagcccctcatacaacattcatgccagggcaatggaagaatatcgcaccaaccttgccctcatccccagagatgcaagcctcacccactgaggccagccactctcatgggtgtctgccccacccacctcacttttgtccccacacagggaccttagccctcctacttacctctctctccctcccccacagcttagtcccatattcaagaacaccagtgttggccctctgtactctggctgcagactgacctctctcaggtgagaccttagaagatccagcctggctgccccagttgttcccactccagtagattttgctctgcttccttgctgcacctcctagggatatcctcaccaaaaggggaattcaggagtcactggcttctggaccaatgtgtttcctgatagtaacactcccacacctcacctcaacagggagaatctgcatggtccatcatcaggattgagcctctatcctgatcatccctcagaattccctgcccctccctttcatttaggtgttaaattctgtccccagaatttctctcaagacaatcatgcctcatccaagtgctttcatccctgtttctagctcttcactggtctcaagtctgggctctcctgtccccatgctatgagaatgcaggtttcaccttgcacttttataagcatggttgtatctgtgactctgtgcacagtcccaagcaagccagtagtccatgcactcagagaatctaagtgtagcttctcacctctttcccaggtttctcatttcctctggttctttactgtctttccatcagcagtctcaggacacaacctaagtaatcttttcatagtcattctccccacctaccttccccaggtctgagaaggatggagcagccactggagtggatgccatctgcatccatcatcttgaccccaaaagccctggactcaacagagagcggctgtactgggagctgagccgactgaccaatggcatcaaagagctgggcccctacaccctggacaggaacagtctctatgtcaatggtgagcagctgtgatgtggttggagtcttttccttctagagtctggaaagaatctaatctgtggcttgaagtcacactccctgcctggccattgaatattctgtcatgtggtgtagatgggatgacaaagttctggacttcacagtttcttcattgtcgtgaactgtgttccctcagggcactcttccctgttgtgaggatactgataggaattctttaatggccccagtcccatgaaactcattgtcccatgaaactcatttaattgcattgggattgccatgaccttattgtgtccctcgtatctccttaacgcttaccaagtctcctccctccttctctatgcaggtttcacccatcggacctctgtgcccaccaccagcagtgagtattcaactcatgtccacatgcccctgatcctacattaagtggagcaggagctggcccctcctcttaaacccataagtcctcctcttgagcaaaggagctgggaaggcagaagttattgaagctcccttccacctagctccaaagacaggcccagctcatgcccgtatgcagcagacctcataatagtctaccttcttgccatttctgccatgagattattttctgctttcactgatgagcactttttctcagctcctgggacctccacagtggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttcaattcccactacagctgctggccctctcctggtgctgttcaccctcaacttcaccatcaccaacctgaagtatgaggaggacatgcatcgccctggctccaggaagttcaacaccactgagagggtcctgcagactctggttagtgcccttccctcctcactctgcccagccccagatatccagtcccttctacatcatccatgccagggtgatgaaagaagatagcaacaacttccccccttccccccaagagatgcaagccccacccacagagaccagtcctgcttattggtgcctgctccacccacctcacatctgccccgacacacacacaccttagccccactactcacctccctctccctcctctacagcttggtcctatgttcaagaacaccagtgttggccttctgtactctggctgcagactgaccttgctcaggtgagactttagaagagccagcctgggtgcccaaacttgttcccactctaaaagactttgcactgcttccttgctgcacttcctaggtatatcttcaccacaaggggaattcaggagtcattggcttgagaaccagttgtttcctgatagtaacacccccatgccccaactcaacatgcaaaatcttcatggttcatcatcaggattgagacactaccctgattacccatctgaattccctcctttccctgacccctccctttcatttaggtgttaaattctgtccccaggatttctctcaagataaccatgcctcatccacatacatgcatccgcctttcaagctcatcactagtctgaagctctgggttctcctgttcccatgccatgagaatgcaggtttcaccttgcacttttataaaaattattatatccatgactctgcttgcagtcccagaccaagatagtggtctatgtactcagataatctaagtgcagattctcacctctttcccagatttctcatttcctctggttccttgatatgtttccctcagcaatctcaagacaagtcctaggcaatcttttcattgtcattccccctcctaccttcctcaggtccgagaaggatggagcagccactggagtggatgccatctgcacccaccgtcttgaccccaaaagccctggagtggacagggagcagctatactgggagctgagccagctgaccaatggcatcaaagagctgggcccctacaccctggacaggaacagtctctatgtcaatggtgagcagctgtgatatggtaggggtctcttcctcctggctgtgcaaccatctaatctctggcttgggggcacactccctgcctggccattgaaaattctgtcacgtgctctacatgggatgactaagttctggacttcatggtttctttgttatcatgagaggcattccctctgggcactcttccctgttgtgaggatgctgataggaaatctttaatgacccctgtcccatgaaactcatttaattgcaccagggtagtcctgaactctatcgcgtcccccacatctccttaacccttacccagtctcctccctccttctctatgcaggtttcacccattggatccctgtgcccaccagcagcagtgagtattcaactcatgtccatgatgcccctgatcctacatcaagtggagcaagagctggcccctcctctttaacccataagtcctcctcttgagcaaatgagctgggaaggcagaagttactcaagctcccctctgccccagctccaaagacagacccagctcaagcccacatgcagcagacctcataatagtctatcttcttgccatttctgccatgagagtgctttctgctttcactgatgaggacttttttcagctcctgggacctccacagtggaccttgggtcagggactccatcctccctccccagccccacaagtaagtaccagccaatggtatctgtattagatcatgcctgatgaatgcaaacatctgtgccattttcagtcaaatgaaaatggaaaatcataataaatctagtgatactgagtgaaccaaaaaaaatgtattggccacctacagtgtaccagaccctagggatatagcaaggaaaatagaaccaataaaaacatctctgccctcagtgagcttgtgttcatgtgatgatatgatggtggtggtggtggtaatagtaataatgacatattcagtttgatgataatttatgattatggtgttgctgttgatgatggtggtggtgatgttactgacaatgatggtgacggatctttgaggatattgtccgtgatggtcgtgaagattatgatgataatgatgatgtgttaagtgtgatgatgatgatgatctgtggtgatgctgtttaggatgctgttccgtggtaccgatgatattgatgttggtcgtggttatgttgtatgacaatgacaatgatggtgatgaggataatcgccagtgatggtgtgggtttatgatgatgatgatgtgttgaatgtggtgatgataatgttcgtggtggtcgtgatgggcattactatggcagtgatggtcataataatgatggtgatggtgacaatgatagcaaggatgatgatggcaataaagatagtacataacatcagacaatattgagctctgaatatgcaccacgaggagtgctcagcatctaaatactattatataatatatttttgtaaaaataaattgtattgttttaggcaagggaagcatggtaaatattttgtcactcaatttaaattctgcatatgtttaaagataagtctattgcaaactcctattttctctactttggacatagtgtttgtttcccacctccactacagctgctggccctctcctggtgccattcaccctcaacttcaccatcaccaacctgcagtacgaggaggacatgcatcacccaggctccaggaagttcaacaccacggagcgggtcctgcagggtctggttagtgctccaccctcctcactccgccccaccccagagagtcagtacctcctacatcatccatgccaggtgatggaacaagatcatacccacctcacccttgccccaagagatgcaagccatgcccattgaaaccagccccactcactgatgcctgttactgccccacctgacttctgccctacacacccacacacgcaacttagccctcctactcatctccttctccctcctccacagcttggtcccatgttcaagaacaccagtgtcggccttctgtactctggctgcagactgaccttgctcaggtgagaccttagaagatcaagcttggctgccccacttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttagtctacttttgaacactgtttatttcccatcttcactatagccgccagccctctcctggtgctattcacaattaacttcaccatcactaacctgcggtatgaggagaacatgcatcagcctggctctagaaagtttaacaccacggagagagtccttcagggtctggtaagagccccacatacctcattctaccgccactcaccatgtttagtcctgcccacctcacctattgcagagcatggaagatctcatctacctcatcttgcccccagatatgcataccccaaccactgatgccagccccaccaactgttgccagccctgcccacctcccttctaccacacccctatgacttcagtcctcccactcacctccctctccctcctccacagctcaggcctgtgttcaagaacaccagtgttggccctctgtactctggctgcagactgaccttgctcaggtgagaactgagaacagccagtctgactgatctgagcagtttgacctgcttcccttctgcactccctggagatgtccgcagccaggtggaatccaggaggcagtggctctaagaccaatgtgcttcctgttcccaccacctcccacctcaactgagagatgcagagcccatcagcaggactgagcttctaccttggtcatccctctgaattccctcctttcccctacctgcctttccacaagtggttcaattctgttcccaggatttctcccaagaaaaacatgcctcgtccacttgctttcatccccaaacctagctcttcacctgtctcaagtatgagttctccttaccccatgctacaagaatgcagtttccactttgcaattttataaaaatccttgcatccatgattctgctcatagttgctaagagtcagtgcactcagagaatggaagtatggcttctcacttctctaccaggcttctcatttcctctggccccctcctgtcctgccctgtgggatctcagaacccctccctaggcaatccgtgtattgtctttccccaatcttgccctccccaggcccaagaaggatggggcagccaccaaagtggatgccatctgcacttaccgccctgatcccaaaagccctggactggacagagagcagctatactgggagctgagccagctgacccacagcatcactgagctgggcccctacacactggacagggacagtctctatgtcaatggtgagtagttgtgatgtggttggagtctcttcctccttgctgggcagcctctactctctgccttgaggtcacgctccctgcctggctattgaatgctcatccatgttgtctgtatgtgatggctgaggttggaacttcatggtttctatttcatcttggactgagttcatcctcaggatctgctttctggatctgagggtgctgatagagaatcttcaatggttcgtgttctgggaaattccttccattgcaccagggtaccctgacccctatatagttccccaccactcccttaacccttacccaccctcttccctccctctctatgcaggtttcacacagcggagctctgtgcccaccactagcagtgagtatccactgatttccagtgctcctgatcctacatcatgcagggcaagaactgacccctcctcacatgcccctatgtcctctatgagcaaaggagctgggacagcacaagttactccctttcccttctggcccaagtctcttcagagagagacccagctcaagccccacatgcagcaaggtccataaatactcctacctgctggcatttctgccatgagagggttcaacactttcactaatgaggccttctcctcagttcctgggacccccacagtggacctgggaacatctgggactccagtttctaaacctggtccctcgggtaagtacaaatcaatcgcatctctgttagagcatgcctgatgactgtcaacatctctgccattttcacttaaataaagataaaaaatcctagtgaatctacggatgaggagtcatccagcaaacttaattgagtgcctagtttctgcagggctctagggataagaaaggggacacaaaacagttaaaaatatctgctgcaagaaagcttattttattgtgagggtgatgggagttggtggtggtgaagttactggagatgatgacaataagaatggtgatgctagtgatgatgatggtgataaggatgataattatgaagatggtggtggtgatgatgatgatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgccagccctctcctggtgctattcactctcaacttcaccatcaccaacctgcggtatgaggagaacatgcagcaccctggctccaggaagttcaacaccacggagagggtccttcagggcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaggtccctgttcaagagcaccagtgttggccctctgtactctggctgcagactgactttgctcaggnnnnnnnnnnnnnnnnnnnnnnnnnnnnnnnnnnnnnnnagaattcagtcgacctaccggctttgatgattgctcagttgaacttagaaatgcactgtctgcccaatggtccagtctcatgagtgtgactcttttctgcctctcttgggtatctgatcaagatggactcaggaaaagtgctccagataactgtctccaatataacactgcccctgccatcacacccaaatgactggaagtttcacagggtcatcagcagggattggacttccaccccggccatccctctgaattttccctcttttctccccacctcccttgcccttaggtgttaaaattctctaactaagatttctctcaagacaaatgtgcctcattcacttgtttaattcccaattccagcttgtcacctgtctcaagtctaggctgtcctgtccccatgccatgagaatgcaagaaccacactgaaatgttagaaaaattcttttatccacaagtatgctcaccgtcccaagctggacagtagtcagtgcactcagagaatctaagtgtggcttctcatctgtgtaccaggcttctcatttcctgtgggcccttcttgtccttccctccgcaatcttgggactcctccctagacaaaactttattattattcccctcacctgccctctccaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtgagcaattgtgatgtggttggagtttcttcttccttgctgagcaggcctctactctctgtcttgaggtcactctccctgcctggccactggtcttggccatgttgtctgtatttgatgattgatatgaacttcaccgtttcttcttcatcttgtactggagaccttcatcctcaggaccttcttccctgatctgagtgtacttgtatagaatcctcaaagcccatgttccctgaaactccttcaattgcaccatggtagcactgaccccttttggtcccccaccttnnnnnnnnnnnnnnnnnnnnnnnnnnnnnnnnnnnnnnnnnnnnnnnnttcactcatcggagctctgtgtccaccaccagcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgggacccccacagtgtatctgggagcatctaagactccagcctcgatatttggcccttcannnnnnnnnnnnnnnnnnnnnnnnnnnnnnnnnngactccagcctcgatatttggcccttcaggtaagtaccagtcaatggcacctctattagagtatgcatgatgagtgtcaacatctctgtccttttcactcaaataagattaaaaatcatagcaaattgtacgtgatgatgagtcacccaacaaacttctttgagtacccactctctgccaggccctagagataaggcagggaacacaaaagaggtaaaaatctctgccctcagagagcttcttttattttgaggatgatgtgggatagtggtgatgatgatgttgctggagatgattacaataatgatggtgatgcttatgaccatgatgtgatgatgatggtgattatgaagatgatgatgatgatattgatgatggtagtggttttgacagtaatgatgatgtgatgatgatgatgatagtggtggtggtgattatgggaaggatgacagtggtggtggtgatggtggtggttgtggtggtgattgacaatgtggtggtgatattgacaatgaggatgatgatgatagtggtggtggttatgatggttaaggatgatgtgatgatggtgttggtgatcacggtactagtggtggtgatgtggaccgtcatggttgtggttgtggtggtgatggtggtgatcatgatgataatgaggatgatggtggtgattgtcatgatggtaaggatgaaacagtgatggtgttggtgaccatgttcctggtggtgatggtgcaggtgatgatgtggatgatgatggtgatggtggtggagatgatagggattatgaatatggttcgggtctctgactggtggtggtgatgacaataatgaaaatgatggtcacagtgttggtgatgatgatggtggtgataacaaaggtaatagatagtgtctagtattatggaacacagaacatcaccaaaggttatgctcagcatctaactattattatttagcatgctctatgaaaaactttgatcgttatagtcaagggaggcatgaaaaccttctattttatcactctctttaaatctggttgcatatgtttagaaataaatctattacaaactcttaaatgttctctacttttgaacatagtgtttatttcccacctccactacagctgccagccatctcctgatactattcaccctcaacttcaccatcactaacctgcggtatgaggagaacatgtggcctggctccaggaagttcaacactacagagagggtccttcagggcctggtgagagccctgcccacctcactctgccctgcccaccttgtcttgttccacctacgtcacccattccaaggcatggaagaagatctcacccacctcccctcacctgagagatagccccgccccctgattacagccccttccaccttacatcttcctcacttctatgtcctcagccatcttactcacctccctcttcctcctccacaggctaaggcccttgttcaagaacaccagtgttggccctctgtactctggctgcaggctgaccttgctcaggtgagaactgagaataaccagtctggctaccccaagtgttcccaggcccaaggagtttcatcagctttcttccttccctccctatggaagtcctcagcacaagtggaattcaggcgttggtggctccaggatgaacatatctgctgatcctaccacctcccccatcaatcgagagaatttgcagggcccatcagccagatcaggcttctactttggtcatccttctgaatttcttacttctccctacctccctctccttcaggtgttaaattctcttccaaggtttctctcaagataaacatcccccatccacttgctttcatccccaattccagctcttaatatttctcaagtctgggctctcctgtccccataccatgagaatgcaattttataaaattcttgtattcctgactctactcacattcccaggctgcctggaagttggtgcattcagagaatcttagtatggcttctcacctgtctaccaggattctcatttcctctgtccccttcctgtcctgcccccaggaatctcaggatgcctccccataggcaatctatttaatgtcatcccccttatctgccctccctaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtgagcggctgtgatgtggttggagattcttcctctttgctggacagcttcttactctctgacttgaggtcacactccctgactggccattgacgtcttggctatgttgtctgtatgtgatgactgatgtctgaacttcatagtttcttcatcttggactgagttcatcctcagtaccttcttccctgatctgagggtactgatagagaatcttcaaaggcccctgttccttgaaacttcttccattccactagggtatctgtgacccctatttgattccccacctctcccttaacccttacccactctcctccctccttctctgtgcaggtttcacccatcggagctctgtacccaccaccagcagtgagtattcaaccgatgctccagtagccccaattatacaccaagcagggcaggagctgtcctgtcttcctatgcccctatgtcctcttcataaaggaaggggctgggagggcacaagttattccctttcccttctggccagctccagagagagacccagctcaggcccgatatgcagcaaggcctgtaaatagttttatttgctgacctttctgccatgagaggcttggatgcttcccctgaagagggtttctctgtagctcttgggactaccacagtggacctgggaaactctggggatccaccccttctactggtcccttgaataagtaccagccaatggcacctctgttagagcatggctgatgagtgtaaacatctcttccattattcagtcaaataaagatggaaattctttataaatctagtgatgatgagccaaccaacaaactttattgagcattgtgacaagccctggggctctgccaaatcctggggatatggcatggatcatgaaacaattaataatctctcctctcagagagctatttttatgatgatactgatggtggcaatgatgatgatgttgatggtgattatgaccatgatgacaatggtgatggtggtggtgatgatggtaatgatgatgatggtgatgttggtaatgatggtggtgattatgacaataatgatggtgatggtgacagggatggtgatgattatgatggtggtggtgataacaaagttaatggataatatatgaacttattggctactgaatatgcaccaaagtgctatgctcagtgtttaactagtactatttaatatgatttctaaaaaaaatcttgaattattataggcagaagaatcatgggaaccttttattttgtcactcactttaagtcctattgcatattttttaagtcaattgcaaacacagtttctctgctttgaacattgtgtttatatccagtcaccccaatagtgcataaacctgctgattggagcaactgtgtcttactcccttgtgcttccctagtatctgcttcaggaccttgtacatggtagatcgacagatttagatctacaggaaaatatggattttcccagggaaggaaggaatgaagtatgctttcttataatgtatggaaactttcctcttctgccttggttcaactttagtgtctgccagagtttacactggaaaactatatggcatctgctccactccctcatccatgacagacatcattaattgattgcagcattcatggcagacatcaccaattgataatagcattcattttctctcagttcaaaacagcttcagaatggttaccaaaaaaaaaaaattcagtcgctaccaattcaattggagctgactcaggattatgggacagaattcaagagagttaggttccttgatgatgtgtagtggctatttgttttccggtccaggctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgtgcggcaaagttcaggggccccaaaaatttctgtgccccaatcatggcggacctaggtttaggcacaaattccagggattaagtccctggagatgttatggcttttggttttcctagaaaggctcagctcaggctcagcttggtcatgctgatatcctttcttccacttggtcgatttggctgttgatacttatgtatgcttcacgaagtttttgtgctgtgtttttcagctccatcggttggtttatgttcctctctaaactggttattctagttagcaattcctttaacctttcatcaaggtgcttagctttgcattgcattagaacatgctcctttagctcatcgtacttttttattgcccatcttctgaagcctacttctgtcaattcatccatctgatcctccatccagttctgcacccttaatggagagatgttgcggtcatttggaggaaaagaggcactctggccttttgggttttcagcatttttttgttgattatttcccatcttcaggagttttagtttcaggctttgaggctgctgatccttggatggggtttttatgggggtcttttggttgttgttgttgatgatgatgatgttattgtcactttctgcttgtttttctttcaatagtcaggtccctcttctgtagggctgctgcagtttgctaggggttcacttcaggccctattcatctgattcgctcccatgtctggaggtgtcactcaaggaggcttggagagcagcgaacataggtgcctgcttcttctgggacctctgacctcgagggacaccaacctgatgccagtaggatcgctcctgtgtagggtgtctgacaactattgttggagggtttcgcccagttgactggcatggagagcaggacccatttaatgaagcactttgtcccctggtggagagggggttcttcactggggggaaaccacatgtctgggctgcttggattcctcagaactaccagaggagaggctaagtctgctggtccacagagactacagccatccctcccactaggggcccaagcccagggagtccaaattctgtctctgagcctctggctggagtctttggagatcctgcaaggaagctctgcccactgaggaaggatgggtcagggttagccctgaagaggcactctggctgcagactgccacagccggtgtgttgggctgtggggacaagtcttgggaccaagccgtccagcctacccggctctagcaggggaaaagtacagcctggagctattgaaaggggtgccgcccttcccccgcccagggagcttagcgtgttaggcagttgtgagtccagtgctggctgtcgccccttccccaaggaacaaaaaagacttagcaggcagccgcagccagtgctggtcgcccctcccccggggagttccgtaggcttaggcagattccagctgtaagaatctgcgtgttctggggttgggacactaggtcccagtggcatgggttcgcgagtgagatcttccaatctgtgagttgcacagttccgtggaaaaagcacagtttccccctcttgggtagcccgctcactcaccacctcccttggctggaaggagggggttccccttccccgtgtgtctctcaggtgggccaccacaccacactgctcttccttctctctgtgggtcactgccagccttctagtcaattttgatgagggaacctggacattttggttgccaggaaggatcacacacttattacagtttttttcaatgtgagcctctgagcgctgctgcttatagtcgaccatcttggcccccagagtcacacatctgttattttttgatgttttgattgtggcaattcttgcagaagtaaggtggtatcaccttatggttttgatttccctggtcattagtgatgttgaacatttttttcatatgttcattagccatttgtatatattctttcaacaactgtctatttatgtccttagcccactttttgatgggattgtttttttcttgccaatttgtttgagttcgttgtagattctagatattagtcctttgttggatatatagattgtgaagattttctcccactctgtgggttgtctgtttactctactgactgtgaaggaaaagtcaatttcttatacgaatttgtctcactcctacttccaaatgagatcctggggttttttttttctgttaatccttcacaatacttctcccacttttttgaactcatttgtttatattctgttgtctgcttctcttttataggaatgtgacttcttatgggctttctctattataccacatatgggtttttgttttgttttgttttgttttgttttgtttttgtcctcggatccattctccaacctcctccagccttcccgtgctctgtgggatagacgtctgactcatgaaaactacatttcccaggctcccatgctaactagcttcctgttaggttcagccaataggaggcattggtgggacaatggtgggcggggctatggaagggccagagtatttctgtaccccgcccccctgctccccttccaatgttcctggagcggtgtaggaccaatactgtatatatggaaggaaggcaaggtggatagattggaaggaagaagtgacagatggaaagaagaagtgataaatggcaagcgaggcaagggagcagaggatggatgagtggattgcaagaaagaaaaaaatggatgaaatataaaaggagcaggacagatggataagtagatggaagtaagaaaagactggtgtaagaaaggaacgattgatgatggatgatgaatggatcagtggtgattgggtgaagggatgaatggatggatggacagatggatgaacagatgggtgggtggatagatggatggatggataaaatgggtaggtggatggatggatggatggacagatgggtgggtaggtggatggatggatagatggatggataagtgaatggatggatggatggatggatggataaatggatggatgggtgaaaggaaggaaagaagtgagagaaggaagaggaaggatagacagatgttagaaggtacaaatgaaaggaaggaagccagcaagaaagaaaggatgcattaatagaatgaaagatggaagggaagaagaaaggatggaaagagagaaggaagaatgaacagaaggaagttcaagagtggtgaaaagaagaaaggcagggagagaaggagaagtaaacttttcttctagagatttgtcttaaaccttagcttggctggacactgtggttcacgcctgtaatcccagcactttgggaggccgaggcgggtggatcatgaggtcaggagatcaagaccatcctggctaacacggtgaaaccctgtctctactaaaaatacaaaaaaaatttagtcaggtgtggtggtgcatgcctgtggtcccagctactcaggaggctgaggcaggagaatggcataaaacctgggaggcagagcttgcagtgagccaagatcacaccactgcactctagcctgggcgacaaagtgagactctgtctcaaacaaaaacaaaacaaaaaaacaaaaacaaaaaacaaaaccaaaccaaaacaaaaaaaaaaaccttaactcatactttcataaagttccacacacagggagtgattagaaagcatttgctgatatattttatataataaacatgtacaccatattgacctgtgtgcccagcagtgcttacatgatttacaatgattaacttgtttaagcttcataacaacggttgaggcaggaaacatcattgtgaaccattgtcatctcattttacagatgagtaaactgaagtgctgagaggttggttatggctgcaaagattgttggccatgttaaccaatgcatagaagattagcatacctggttgtgagtgcaggagagagagagaaatgggagaaaggcagagaaggatcgatggggagagaggaagagagagagagagaataaattttttaaaaatgtctagagtcatgacttccgcatcagtgtggtaatatgcagcctttaccctgggaaagatcagaaccattggtactttttacagaatcttcccttcctgcatttgggtagaaggaccccatctggacatcccaaatcattaagcacacccttactggctgctggagttgtctccattaaaagtcaccgttgggtttattaagaggcggacacagggtccttagaacacactgcccccacctgtcccacaccaccccccacccacccatcatcctccccaagagcttcatctctctctctcttccccctgccctagccggggtggtcagcgaggagccattcacactgaacttcaccatcaacaacctgcgctacatggcggacatgggccaacccggctccctcaagttcaacatcacagacaacgtcatgcagcacctggtgagaggcctgcctcccgctgcagccctgccatgcccatcctagggctgttgcctgcctgcctctgaccaacccaagctcccttctccctctgcagctcagtcctttgttccagaggagcagcctgggtgcacggtacacaggctgcagggtcatcgcactaaggtgagaaactcccccacccacagcgcaccaccaagaacttagagttctgactgggaggtccctcttgggttggggtgggctacatatttttttaaatctttttatctttcctttttttttttttgagatgaagtttcgctctcgttgcccaggctagagtgcaatggcacgatcttggctcactgcaacctctgcctcccgggttcaagtgattatcctgcctcagcctccccagtagctgggattacaggcaggcaccaccatgcctggctaattgttttgtatttttagtagagatggggtgtctccatgttgatcaggctggtcttgaactcctgacttcaggtgatccaccctcctcagcctcccaaagtgctgggattacaggcgtgagccaccatatctggccccattctttttttttaaatgaatttaaggagtgcaaatgcagtttttgttacatgcatatattccatagtgaagtctgcagacagtagacttccagacagtagcttctggtgtatcacccgaatagtgtacattgtacttattaagtgaggttccccacccttctcccactctcccacctttctgagtatccagtgtctattattccacactccaggtccatgctctcacgtataagtgagaacgtatggtattccaccatgagctaatggacatggagtccattggctcccacttataagtgagagcatgcggtatttgactatttctgagtttcacttaagataatggactcccattccatccatgttgctgcaaaatacatgatttcactctttttatggctgaatagtatttcgtggtatatatatataccacattttctttatccagtcttctactgatggacacttaggttgggtccatacctttgctgttgaaatagtgctgcaataaacatacacgtgcaggtgtctttcttatataaatgatttctttttttctttccttttttttgatataacgaatttcttttatttgggttaaatcccccaatagtgggattgnnnnnnnnnnnnnnnnnnnnnnnnnnnnnnnnnnnnnnnnnnnnnnnnnnnnnnnnnnnnnnnnnnnnnnnnnnnnnnnnnnntgacctgtccgtattgatatataaaatgctgcatttaaagtgtacaacttgatattttggtatacattgttaaatcatggccacatttcagctaattaatatatctattatctctacatagttatcatgtttgtaccctttgaccagcatcaccccatttgctcctcctcccagcccctggcaaccaccatcctactctctgcttctatgagtctgacaattttagattccacctataagttagattatgcggtatttgtctttctgtgcctggcttatttcacttagcctaatgtcctccagctccatctatgttatcccaagtggcaggattttcatctttcttatatatttcattgtatatgtgtatgccacattttctttacccattcatccattgaaggtcatttagcttgtttccatatcttggctattttgaatagtgctgcaatgaacataggagtgcagatatctctttaagatactggtttcatttctttctttcttctcttttttttttttctgagacagagtctgactctgtcgctcaagctggagtacagtggtgcaatcttggctcactgcaaactctgcctcctgagttcaagcgattctcgtgcctcaacctcccagggagttttgctcttgctgcccaggctgaagtgcagtggtgcaatcttcactcaccacaacctgtgcctcccgggttcaagcgattctcgtgcctcagcctcccaggtagcaaggattacaggcgcccaacaccacaccaggctaaatttttttgcatttttagtagagacggggttttgccatgttggccaggctggtctcaaattcctggcctcaagtgatccacctgcctcagcctcctgaagtgctgggattttacaggcatgaaccaccacacatggcctcatttcttttagatatatatgggttgagctattctcagagggtccttttctgcatctatttaagatcacattttttttatattgtggcaaaaatacatgtaacataaaatctgccattttaaccatttttaaatgtacaattcagtgacattgattatattcacaatgtcatacagccatcaccactatttatttctaatacttttccattgggtagatccccaacagtgggattgctgggtcaaatggtagttctgattttttttttttgttttttgagaaatctccatactgtttttcatttgaggttgtactaatttacattcccaccaacagtgtataagagtttcctaggccgggcatggtggcttatgcctgtaatcccagcactttgcgaggcccaggtgggtggatcatgaggtcaggagatcgagaccaccctggctaacatggtgaaaccccgtctctactaaaaatgcaaaaaattagccgggcgtggtggcgggtgcctgtagtcccagctactggagaggctgaggcaggagaatggcatgaaccctgaaggcggggcttgcagtgagctgagatcgcaccactgcacacttcaacctaggcgacagagcgagactccatctcaaaaaaaaaaaaaaaaaaaaaggtttcctttcagtgcatccttgccaacttgagttttctgggttggtttgcactctcatggtatttactagatacttctccatttatatttttactcaacccatgcccataacaccactcctctaccattcccaccaaccatgtataagagttccttttcttgcatccttgccaacttgacttctttgggtcagtttgcactctcttggtatttactatttacttctccatttatatttttagtcaactgatgcccatggcaccgctcctctgaggcaggtgctgggtactagagtgataagacagatgctgtccctgccctcacccagtggagaagaacagatgctaaacaggaacataaatatctaagtaaaatggcttcaaatggagtaaagtgatatgaaacataaataaatagcaagtgatgggtagagcaactttacccaggatgaatcttgggctgtgtcccaaatggccatgaaaactgttccaggcagggagaacagcatgagaaaaggtcttgaggtgcaaatgagcttggcatgttctatgaacagcaaagaggccagtgtggctggagcagagagagagcaagaagaaaagagagaaaggatgagactcaagacatcagcaagtttgaagggccttggaggacttggatttttttttttaagacagctttgttcttgttgcccaggcatgatctcggctcaccacaacctccgcctcctgggttcaaacgattcctctgcctcagcctcccgagtagctgggggtaacaggcatgtgcccaccacacctggctaattttgtatttttagtagaaatggggcttctccatggttggtcaggctggtctcgaactcccgacctcaggtgatccgaccgcctcggcctcccaaagtgctgggattataggtgtgagccactgcacctggcttggattttttttgttctatattgtggtaacatacacatcacattaaattgatcattttagctatatttcccgttcagtggcatcaagcacattcacattattgtgcaaccatcaccactatcatccatctccagaactttctcatcttcccaaactgaaactccatccccatgaaacactcattcctcatccccctcctcaagcctctggcacccaccattctactttctgtctctgtgaatctgatgattctgaggacctcctatgaatggaggaatcatatggtatatgtcctggtttatactgtatggctggcttatttcaccaagcataatgtcctcaaagttcatccatgttgtagcatgtgtcagaattcccttccttttccacttgtatgtaaatgctgtattgtgtttctccattcattaggactttgatttttgcagggagttgtcaaggggtgctgggttctggggcttcaatataataagagtaagctaaactggttcatttcctccttcgtggagaccatgttctggtaggaacaggaacaaataatttatgattacatagagggtgaccagggcagtgacaggggaagagtggaggattgtgggacccagaggaggctcctgaccttgcctaggaagataggaggaggaagaggaggaggaagaggaggaggaagaggaggaggaggaggaggagggagtcctctaagctgagacctggaggatgaccaggaagttatccaggtaaggagaaatggggagaagcttccagacaaaagtaacagcaattgcaaagatcctgagatgatagataaggtcaggtggagaaagtgcaaactgtcaatgagaccaaaatatggactgtgagttgtgcagtgaccacaagtggagaggtgctaggtggccttcatcccccaaagctgcacctctccctcctcaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggtgagcagctatcagccccatctccctgccccaccccccagcccccactgcagtccaggagggtgtctgtttgccggttctctagggaaagacttggggttcaagtcttggcattaccactggccctcccataaccacaatgcaaggttggactttgattaatcccattttacagatgaagaaactgaggcttagacaggctaagcaatttaccttgacagtggtggaaccaggatatgaactccacttgtcagcattcggtgctatgatccactccacatgtttaactcacagaagagtcttcctggtgggggcacttgggggacaaaaaacacatttccggctgtgagcagtggctcacacctgtaatcccagcactttgggaggccaaggcgggcggatcacaaggtcaagagattgagaccaccctggacaacatagtgaaaccctgtctctactaaaaatacaaaaattagctgggtgtggtggcgcacgcctgtagtcccacctactcgggaggctgaggcaggagaatcgcttgaactcgggaggcagaggttgcagtgagccaagattgcgccattgcactccagtctgggtgacaagagtgaaactctgtctcaaaaaaaaaaaaaacaatttcccctccctgctttcttctcaccattgacgagggatgggcttctctcctacctgaggccccctataccaggaagatctatgggatctaatcttcagcgcacactgggcctcagcattggtctagaactcaggataagatagcatttaagaaggcatcccctaaatggggttctgagaggcaaagcatgaccgtggagaattgacaaaatagctcgcctttcatcccctccaccgccaacccaagaacagtgcttatcatcatgaccccatgaggtgggcaccccatatcacttatatgaggtacctttaggtaggtaccgggatgtggagagacatcctgggctttcattactcttattttagcaaagagggaatctgaggcacagagaagggaagggacttgcccatgcccacagcgagtttttggctagtatgggtcttgatgttctttctgggtccgtnnnnnnnnnnnnnnnnnnnnnnnnnnnnnnnnnnnnnnnnnnnnnnnnnnnnnnnnnnnnnnnnnnnnttcctgcgtgggagatgtgtggatttgatttgtatctggaaagatgattttttattggtgacaaagcagttaaagttaatcttcacagttgtgcggagagtgaccacgcgagttagtcttatccttatttttttgatcatcccgctacacaagacaaagcgaaccgcacaggcaacatcagcaggccccattggtgtgttcccctctatgggtccatgtgttctcatcattagctcccacgtataaagtgagaagatggcagtattggttttctgttcctgcattagtttggtaaggataatgacctccagctccaaccatgttcctgcaacggacatgatctcattcttttttatagctgcatagtattccatggtgtatatgttcctcatgttctttatccagtctatccttgatgggcatttaagtagattccatgtctttgctattgtgaatagtgcttcagtgaacaggtgtctttatgatagaaaaatttatatgcctttgggcatatatgcagtgatgagattgctgggtcagacggtagttctgtttttagctctttgaggaatcatcctgctgctttctacagtggatgaactaatttacactcccaccaacagtgtataaacactcctttttatctgcaacctcagcagcatggttttatttctctttatggctgaatagtgttccattgtgcatatataccacactttctttatggattcatctgctgatggacatataggttgattccacatctctgctattgtgaatagtgctgtgataaacacacaggtgcgggttgggtcttgatgatctcagttaacatccagtcccttcaacttggctattgcagggagctgttcccccttgtaaactgcacagcttatgtgcttcattttgttccttcatttagatttaccaagcagctactattaaccaggccacaatgtgcctcgcccccaggaacagagataggttacatgtgcatcctgtcctaatgtaatctccaggggggcggagactgttttgttctaccctatattccccaaatgtaaagggagccttgcacatactaagcccttaataaacattcattgggtggaggaatagattggaggaggcctggaaggggaggcgggggttatggatggataggaggatagacttgtgaacacaaaggtagtgagagcctctcattggaggcatgctggagacgtgagtagggaagggtcagtgctaattgaaatatcaggaaattctttctagtggtgaacacatttaagtcaaatattagatgatacataaatgtatccataatctctagatacacaaagggaaaggcatccaggcaggggccccatatggacaaaggcatggagtatctgggacggttccaccacctcctcttacgtgtgacttctttgtttcaaggttacaatgaacctggtctagatgagcctcctacaagtacgtgtctttgaatctagtgcccatttcaatctccatgggtcttggttcaagcttttctcctcattcatgaaggaaggttgccccaaattcgggctggtcccctaggtggtgaggggcattgtctcagtgggaggaagaatgctgagtccttggccctgtttttagacctgcagccatagtcttggctttgtgaattttccatgtccctctgggttggaggaagaagtttgaacaagcattccctacacgggatagaggttgaggtcagatgatgacctctgttagtctgtaccctccttgataagaaaatctcctccaagtgccccagcagaggcttcatggtcaagctgcagactctgctggctactggttttggctaaatttgcccattgcctcatccagtgatccactcgtctatctttccagccatccatttttctatccttccagtcatctctcagacaccacctgtccttccatccatccatccgtccatccatttacccatccatccatccaccccattttcctgaccatttacctcctcgtccttccttccatctgtccttttatccatctattcatccatcacccatcctcctgcccattcacctgcttgtccctcctttcttctgtccttctatacatccatccatccatccatccatccatccacccatccactcatccaccacccacccatccttctgcccactcactcgctagcccctccttccttctgtccttccatccatccatccacccatcttcctgcccattcacctgcttgtccttccttctatctgtcttttatccatctctccatccattctcaccatccatccatccatccttctccctattcactggtttgtctttccttctgtccttccaaccatccacccatctctccattcattctcctcttcattcaccatgtttccttatttctgtctcttccatccatccatctatccagacagacatctcctccccccattctcctccccattcactcaattgtccttccttccatctgtccttttatccatccatccacccatccatccatccatctatccttctccccattcacctgtttgtccttctttctgtccttccaaccatccatccatccatcatccatccatctatccttttccccattcacctgttttgtccttccttctgtccttccaacatccctccatctctccatccatcctcctgcctattcatctgcttgtctttccttccttctgtccttccatccattcatccatctgcccatccacccactcatcctcttgcccattcacctgcttgtccttccttccacctgtccttttatccatccatccatccatccatcttgctcactcctccactcacacaatcactccttccctcagtctcatttatggcccacctgtgaatggttgtcctggcttggaccactgatgaagcccaggggagcttctcccactagtggtgggcttttgtcctctctgatggactgttccttccacagctcccaagccagccaccacattcctgcctcctctgtcagaagccacaacaggtatttggggccatttttcctcctcgaagattagaatagcatttcaatcagacacctgccctcgtggagtcccagattttatgaaataaatagaccatcataatgtcagatgttttggggtgagatacctggcatagttgggaaggaggagggctttctggagaaagtttcacctgaactgagtctttaaggatgactaagagtgattcaggcaaatagggcatgaatagtataactgaaagaggggaatctgtgagcaaagcctcagtggccagaaacagcatagagtatagggagaagtgagagaaatttggtttgcatgaaacataaagcttaacccagagtggatggataagtgagactgaaaggtcagcaggagccagattgggaagggccttgaatgccaagtcaagaaatttgaacttaacactgaaggccatagggagctgtggatggtactagagcaggggcagccatagtgagattgtcatttcagaaagattcttcttgtgttcagtatagagaatgtcctttagacagggcatccagtgagtctgccaggtgctaatcagggtgagagaaaataagacctgaactgggatagggggaggagagagaggatatatgtgatgaatattcagtaaagagaattggtgttacttggaggggagaagacacatagcttctgacttgcgatggccacactcagtttaataatgagcgcagtctgatctagtctcagaccagccctcagttgcagacgtctctcctcccctcctgcagcatggggtaccacctgaagaccctcacactcaacttcaccatctccaatctccagtattcaccagatatgggcaagggctcagctacattcaactccaccgagggggtccttcagcacctggtgagaccctggtcccagcagctcctggtgggataaatcctacccccaacctctgttcctcggcttaccctcttcctccttcctctcaagctcagacccttgttccagaagagcagcatgggccccttctacttgggttgccaactgatctccctcaggtgagaccacttcctggccatttgccagtaacaaccaccccttttgtgaccaccccttcctcagctttcccctgctcctccctccactgctctttacctgcagaggtctcgggacctctctagagtcctcaaatgcctctctccccaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggtgagtgtcaggctgaacttggatttacagtgacttttggggagttggtttctttgtttttgagatggagtctcactctatcacccaggctggagtgcaatggtgcaatcttggctctgcaacagtgattctcctgcctcagcctcccaagtagctgggatttacaggtgcatgccaccacgctcagctaatttttgtatttttagtagagatggggtttcaccatgttgcccaggctggtctcgaactcctgacctcaggtgatccacctgccttggcctcccaaagtgccaggattacaggcatgagccaccatgcccggcccaccatgactattatttgtccctgttgtatgccctttcctctctaaaaaaaatagcccaaggcctggctgggggacacccttccccaaaccaccaaggggagggtctttcccattattttgagtaaatagcatgaaattctttgaccaaattaatgtcataaattgtttgtctctttctccttcacttttgtttccaacttggttgcggtataactatcaaatacaattgtatgtatttaagatgtataatgcagtgatttaatatatgtgtagcttatgaaatgattaccatgatcaaattagttaacactgctttcatgtcacatagttaccgtgtgtctgtgtgcgtctgtgtgagttagagagaaagagaacatttaaggtctaccctcatagaaaatttcaggtttacaatacagtattattaactataatcatcaagctttatactcgatccccagaacttattcatcttgtaactaaaagtttgtattttgtgaccaacatctccccattttctctatcaccacccccatgcccccagcccctgataaccatcatgctactctctgcttctgtaagtttgacttctgatcccacatataagtgagatcatgcagtatttgtttctctctatctggtatatttcacttagcataatgaaccccccccaggtacatccataatgaatttcaattcaaaacccaagtggctgagtcgtggcatcctttgggacaggatagcaggtcccttctatataaggatcctctgtgtcagtggttattaccaggggacaattctgcacttctgccccaccccaccccccaactgggagactctaggcaatatccgaaatcatttttgggtatcacaactcagggagggaaggagggtgcaactggcacctagtgggtcggtagcccattttccagtgcacaggagacaaccaccccagggaatgatccagccccaaatgccaataatttcaagggtgagaaatcctgttgtacatggtctcaaagttcttaggtgggcacaaggctgacatttatcacactttactgtaattacttgttaaatttatctgattcccccttaccctgtgaactcaacaaaattacggtctattatgagtgccactgtaccctcggttcgcagtacatcagcacatcatagtatggaaagaatcattgaatgagtgagcaaattaaagatttgtgtctctgctgtaactcacattcattaattcattcattcagcaaacatatatgggtggctgttctgccccaagccttgtactgggtctggagatagaagacacatttttctgtctctgaaaaactcatactcaagttaacaacaaattacgggcacaacaaagaccccactgctgttattaacagggtactatgggagctgagaggaggagtaaattaaggagggcttcctggaggagggtgttatatacccggccctgtgccgggacacataatgataagacagacttgggcctctgctgtcctggagctccctctcactgggctcttgaagcgtgagcaggagttttgcaggaaatgaaaaggatgcattcctagaagtgggaactgcatagcacatgcaggaaagctcagctcagaagaatctgtgtaatattccatttttccctctctttggggcaactttctgtctaagagctcctgcaatgcccagcgtgtggacctgaaattgattctgacagtaggcaggggactgctgggcaactttggctctgcattttgtgatcaacatttccccaccatatgttgccttttcttcttctctgtggctccaggctatgcaccccagaatttatcaatccggggcgagtaccagataaatttccacattgtcaactggaacctcagtaatccagaccccacatcctcagagtacatcaccctgctgagggacatccaggacaaggtggggcatctctcacccctcccgtcttctctgtcctgtgtgcttctctccctcttctacctgatttctctgttaagtgatcactttaaatgcttcacttcactatgtattctgggttctctctcagtttccaaaagtactctcttgactaccattcccatttcacagatgggcaaactgaggctcagaaaggggcgtggtgtgcctagggtcatacagtgctttaggaacagagttaggatttgaactctggtcccctttgctccaagtcctgtgtttttttccactggcatcagcggcccctccacccccaagaggcctccatctcacccactctccctacccatctttctaggtc

SEQ ID NO: 313 - DNA, 14277 bp, Homo sapiens
  misc_feature (1)..(66): Exon C1
  misc_feature (1802)..(1947): Exon C2
  misc_feature (4198)..(4350): Exon C3
  misc_feature (4679)..(4747): Exon C4
  misc_feature (6811)..(6978): Exon C5
  misc_feature (11232)..(11270): Exon C6
  misc_feature (11594)..(11677): Exon C7
  misc_feature (13375)..(13500): n is a, c, g, or t
  misc_feature (14095)..(14187): Exon C8
accacactctacaaaggcagtcaactacatgacacattccgcttctgcctggtcaccaacttgacgtaagttctgaaggtcataagcagtgaccaagcttgtggctgtgtctctgagcacccttgagctagacgtccccagtggggtacccattctcccctacatccctgtctagctaatcctaccatctcctcccataaatcctcaaggtagggagtgaggattaacctcatggggccaccaactcccagcatacaccttcttttttttctggacacttgggaaaatataactttttgatgtagaactcaaaatattagcccaataataatatttaacatcaaccagcctcctctcatttaattctcacaacagaatctatgagttgagtgcaaaaatcatccctattgtgcagatgggaaaactgagggtcagaaaagtgaacttcccaagaactgtcaaagttgggatttgaacccaggtctctgatgactggatgaaggaatgaagatacctatacttgggaatgaggagggtcgacaggacacgagggctgactttgtatatttctaaacttcaaagattttctgtatttcagctgggaatatggtagaaggttaattggaacaaaaaaatgcaaagcaatgaataagacctcagtatttgctatgcacaacagggtgactgtagtcccacaaataacttcactgtacattgttaaaatataactaaaggtgtatgcttggattgtttgcaacacaaaggatatatgcttgaggggatggataccccatttaccctgatgattattatgcattacatgcttgtatcaaaacatctcatataccccataaatataaaaacacctactatgtaccccaaaaaattaaaaacaaataaaatcaaaagtaggctgggcacagtggctcatgcctgtaatcccagcactttgggaggccagggcaggtggatctcttgagcccagaagttcaagaccagcgagggcaacatagggagtcctagtctctacaaaaaatacaaaaattagccaggcatggtggcacacacctgtagtcccagccactcaggaagctgaggtgggaggatcgcctgagcctaggaggctgtactccagcctgggtgacagagcgagactctatctcaaaaaataaaataaaataataaaaagtagaaatcaagagggaaaatgtgggagaaattgggataattttaacaataccttccaccagagtgatgatgaagaatgcataagtcacttcttagtggtcttgatctataaaaagtgttcaataaatatcgattattgttactgttattgcttctagacgtaattcctggaagcattttttttttttttttttttgagatggagtcatgctctgttgctcaggctggagtgcagtggtatgatctcggctcactacaactgcctcctgggttcaagcaattctcctgcctcagccccccatgtagcagggactacaggcatgcgccaccacacccggtgaagttttgtatttttattagagacagggttttgccatgttggtcaggctggtctcgaactcctgacctcaggcaatttgcctgcctcggcctcccaaagtgctgagattacaggcttgggccactgcatccagccgaaggcctcccattttgatcagaacccttctctagactgagggtgggtgcctctagatcttttgctctttaaagacagcaaccgatgaccctgctgatgctgagtactggctgaattcctgtggtctctgtccctaggatggactccgtgttggtcactgtcaaggcattgttctcctccaatttggaccccagcctggtggagcaagtctttctagataagaccctgaatgcctcattccattggctgggctccacctaccagttggtggacatccatgtgacaggtacaaggtggggtggctggtttcctaactggaagaggtggggttatgaggaaagatggggcttctcggtaccagtggaattggtggaggctctagagagggaaagggaggctttctggagacccatgtaggtgacctctggcagtagatcatccaacgaggcaggaacagaacaccagccattgcatctaagagaatagctatttttacatgtaaaaagaattgtgttgaatgaatgaatcaatagatcatttattttgaatcaatttattgattcattcatttaattaatgaataataaatgattcagtacataattgattaattgatgtaattgagaattgatttaattgattaattgatcaattaaaatgatcaattaaatgaatgaatcagtaaatgaataattcattcattcaataaacaatggaagtaggccgggcatggtggctcacgcctgtaataccagtactttgggaggcccaggcaggcagatcacgaggtcaggagattgagaccatcctggctaacacggtgaaaccctgtctctactaaaaatacaaaaaaaattagccaggcatggtggtggccacctgtagtcgcagctactcgggaggctgaggcaggagaatggcgtgaacccgggaggcagagcttgcagtgagccgagatcgcgccactgcactccagcctgggcgacagatggagactctgtctcaaaaataaataaataaataaaaataaaaaataaataaacaatggaagtaaacacgtactgataacacagtgtgatcattgctatgataagggaatttcaggggcctgtgggagccccaaggaggaacacacaaccttgtcttggaaagttttatgtaggaaggggtgaagaagctgagatctgacagagaatgggacctagccaggggtaatagatggagaattgtgctccatgcatctataacctagaagatagaaagaatatggcatctggccgggtgcggtggctcacgcctgtagtcccagcactttcagaggctgagatgggtggatcacctgaggtcaggagttcaagaccagcctgaccaatatgatgaaaccccatctctgctaaaaatacaaaaattagccaggcatggtggtgcgtgcctgtaatcccagccacttgggaggctgagagaggagaactgcttgaactcgggaggcggaggttgcagtgagccgagattgtgccattgcactcaagcctgggcaaaaagagcaaaactgcatttcaaaaaaaaaaaaagtggcattttggggcaagtttaagaagattggtgtagctggagcatccactttgatactggagaggtgacagttgaagccaaagatgtgggcagagactttgttgggcactggaatggcttggggaggaacatgacacactcatgagttctgctttagaaagaaaatgaaatgaattctgctcatcctctgggtgctgtgtgcagaatggagggtggggggagagaagagcaaaggcaagaagaccctttaggaacaatgatcattagttagaagactctgggtttctcagcacctgcaattgctgactacacccccagagaaacccagtctcttttcccccatgttgtagagaattcttacaatgcttggtagaaagagaattgaacaggtagatgggtggatggatacaagctggacagatggatggaggaagatcctccatccaatatagagctgttacctaaaaccctccatcccacctttaaaatcctagctcagccaggcgcggtggctcacacctgtaatcccagcactttgggaggccaaggcgggtggatcacttgaggtcgggggttcgagaccagtctgaccaacatggtgaaacccccttctccactaaaaatacaaaaaaaaaaaaaagttagccaggcagggtggcgcatgcctgtaatcccgctactcgggaggctgaggcaggagaatggcttgcacccaggaggtggaggttgtggtgagccaagatcacgccattacactccagcctgggcaaagagagtgaaactgtctcaaaaaacaaaacaaatgacccccctgccaaaaaaaaaaaaaaaaaaaaagaaaagaaaaaaagaaaagcctagctcagctcacactgtcaggaataagtaagctagctggaatcatctctttcttaaaaccctgccttgatagtggatttttacatactttttttttaattctagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcggtgagaagggggtggtatgtccactctgttgccatgcagaaactgacttatgcatactgggtagccacagggtgactttttataacaatccacaaagacaggttcttattcccatttaatacacaagcacagagaggttcagtagctgacccaaggtcacacagctaagtcataccctagaagagcatgtcctttgatatacatacctgggcaagtggttgtcatgacaagaagcaaaatagacggagaagtgtgctcagtggctgaaaattctctgatgctactggggccaggattctgacctaagaaacatcgccctgtctttcagctcaaccaactcttccgaaacagcagcatcaagagttatttttctgactgtcaagtttcaacattcaggtaagttctaactcaggacctaatgactctaggaacttctgctgtcctttaaatagaagtgtccccaagccatagctttgatggaagagagccctagaaatagagagctgttaactaaaaactagctttttcctaaagctggagcccaactggcttcaacactcaagagagctggtgtaaatctcagcagacataaaggtacctggtgctgaggccatggagtctagagtgtagaatctactacattaagacatcagctactgaaatcaggacccatggaagacgggggaaggaggggactaaaaccagattacttagaatctagcagcctaactgtgcttttcaatgagaggtatcatttccaatggtggggggtaccaatgattttttttttttgacaactgccttgagaacaggctttcctcactaaacaaattctgaatcagaacaaataaagataagccctgagaatagggctttttcaaggagctgccaaacagatcaaatagtgactatgttctgcagattgatgtctggagaactctacagctattttgactgctaggcagctggttttcacagatatcatgattctgaggctgccagttttcaaagttaccgaggatcttgctggatgcagtggcttgcgactgtaatcccagccctttgggaggccaaggtgggtagatcgcttgagctcaggagtttgagaccagcctgggcaatatggtgaaaacccatctctacaaaaaatacaaaaatcagctgagcatagtggcatgtgctgtagtcccagttacttaggaggctgaggtgggaggatggcttgagcccaggaggcagaggttgcagtgagctgacattgtgccatgcactctagcctgggcaacagagccaaagcctgtctcaaaaaaaaaaaaacaaataataataataataaaatactgaggatcttgaaagagcactgtggaaataatgcaagttaaaatgccacaaagcttgctctttttactgagatttaacactttccttaactaaacacccctcgaatttttgcaagcctttggttcacttctagacttctggaaaaattgatttggactattttggccaatgttctcattgattttatgggtattcagaagttgttaccccaacattccagaaatgttctccctgtggctattactttatttatttatttatttatttatttatttatttatttgagacggagtctccctctgttgcccaggctggagtgcagtggcgcaatctcagctcactgcaacctccgcttcccaggttcaagcgattctcctgcctcagcctcccaagtagctgggattatggatgtgcaccaccacaccggctaatttttgtgtttttagtagagatggggtttcactgtgttggccaggctggtctcgaactcctgatctcaagtgatccacccgccttggcctcccaaagtgctgggataacaggcatgagccactgtgcctgacctccctgtggctatttttaaatgaattaagtggaataaaattagaaattcagttcttctcccacgctagctgcattttaagcatttaataacaacatgaagctactaatggctgcattgtgtagtgcagatgtagaattttttttttgttttttgttttgtttttgagatggagtctcgctctgtcaccaggctagagtgcagtggcgtgatctcgtctcactgcaatctctactccccgattcaagtgattctcctgcctcagcctcccaagtagctgggattacaggcacgtgccaccacacccagctaatatttgtatggatggtctcaatctcctgacctcgtgatttgtatggatggtctcgatctgacctcatgatccgcctgcctgggcctcccaaagtgctgggattacaggcgtgagccactgtgcccggccgacatagaatgtttacatcattgcagaaagtttctgcaggaagagcctagaaggagaaagcctagaatcatgataaaattgcagatatctttgcttatccctgtccccttccaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatggtaaagctccctgggtcattgggactgaggtggaagctcccacttcctcacctgggtccttccctgggaatctgaaggcttggggttgattcgtcatcgagctttctcagactgggagaaagtggcttagttctcctaagctttacccatcattgaaggaaagaaaaggacgcccgagggatatgggaggcatttgccctcttctggccagctctgtgacctcaggctagtcacatctcctttctggacttcttatctctctgtacttagcaagccacttggtttttggttcccatcttgcctgccctagatggtattgctcctccacccccaggcagctgcagtgttaaacaattaccctgattagttattgttgttgtgttgtttgtttgtttttgagacagggtctcactctgtcacctaggctggagtgcagtgacatgatctcagctcactgcaacctcaacccctggactcaagcaatccacccacttcagcctcccaagtaactgggactacagccatgcgccaccacacccggataatttttgtattttttctagagatggggttttgcaacattgcccaggctggtcttgaactcctgagctcaagcatgccacctgcttcagcctcccaaagtgctgggattacaggcaggcaggcaccactgcagctggttctggttttttgtgtttgtttttttcttttagaggcagggtctcgctctgttaaccagaatggagtacagtggtgcaatcatagctcactgcagtcttgaactcctgggctcaagcgatcctcccacctcagcctcctgagtacctggaactacaggcacgtgtcaccacgccttgctaatttctaaattttttgtagagacagggtctcactatgttgcccagactggtctctaattcctggccacaagtgatcctcctgcctcagcaggtcaatgagggcttccagtttcaagttgtatgtgattcatcctcaacaaatgtggtaggatggacctattttccaactccagagatggcttcaaggtggctcaactttgcatatccaattttacccattcaaagaatagttatatacattgtaccatgtatcaggaatataacagagagtaactgtttgctctttcaccactatattccaagaaccccatattctgcctggcacataataaacactcaagtcatatttgcagaaggaataactagatttcatacaaggttcttttcaagtcaaatgcgaataacgttttagacgggaccttccaatgcctgtgtgcactgtccttgattccgaattattgttgtgcaagagagcactgttgatccttcagaatcaacaagcctttcacatgcctgtcacaggtttttctttttcttgttttaccaattttgtttgttgtttgtttgttgttattgttttgttttgtttttgttttttatttgtttttattttttctttttttttgagacagagtctcgctctgtcacccaggctggagtgcagtggcacgatctccgcccactgcaagctccgcctcctgggttcatgccattttcctgcctcagcctcctgagtagctgggactacaggcgcctgccaccatgtctggctaattttttttgtatttttagtagaaacagggtttcaccatgttgaccaggatggtctcgatctcctgacctcgtgatctgcccacctgggcctcccaaagtgctgggattacaggcgtgagccaccacacccagccccaattttttttttaattaaaattgttgtcagctcacaagctttctaaaaacaggccatggacccagcatcgctgtagtttgccaaacccttgccttgaatcagtaccatccaatagaactttctgcagtgatagaaaatgtttctatctgtgctattcagcacaaagccatgtgtgattactaagcttgaagtgtggttaatgtaactgagataccgaagttttaattttatttaattttaatttaaaaagccacttgtggctgctccatattgcacactactttttaaaattattatttgtatatatttaaggggcacaagtacaattttgttgcatggatttatagcccagtggggaagtctgggcttttagggtatctattacctgaataatgtacattgtacccattgagtaatttctcatcatccactctcctccactccccaacccttccaagtttccactgtctattattccactctctatgtccatgcctatgcattatttagcattgacatgtctatgcattatttagtcaaatacatgtgctatttgacttcctgtatctgagttgtttgacttaagataatgaccttcacttgcatccatgttgctgcaaaagacatgatttcattcttttttatgcctgggtggtattgcattgtgtgtgtgtgtgtgtgtgtgtgtgtagagagagagagagatcacattttctttatacagtcctccattgatgggcacttaggttgattccatatctttgctattgtgaatagttttgtgataaacacacaggttcaggtgtctttttgacaaaattatttattttcctttgtgtagatacccagtcgtgggattcctggatcaaatggtagtttcatttttagttatttgagaaatctccacgtttttcatagagattatactaaattacattcccaccaacagtgtgtaacggttcacttttcttgcatcctttttaacatctgttatttttgtctttttagtaacagccattctgactggcgtaaggtggtatctcatcatggttttaatctgtatttctctgattattagtaatgtcgagcattttttcatatgcttgttagccattggtatgtcttctacatctttaagaagctggctatgggctgggcgcagtggctcacacctgtaatcccagcactttgggaggccgaggcaggcggatcacgaggtcaggagttaaaaaccagcctggccaacatggtaaaaccctgcctctactaaaaatacaaaaaattacccaggcatggtggtgcgcctgtaatcccagctactcaggaagctgaggcaggagaatcacttgaacccaggaggcggaggttgcagtgagacgagatcacatcattgcactccagcctgggtgacagagtgagactctatcttgagaaaaaaaaaaagttggctataacagggttgtagaagtagaggaaccagtaacccttctcgccatgcctgatgatggctttacatccctgtcttcatggagtttatgctgtcgtgaggaataacaagaacaggcagttgtcaattataaattatttgatgtgaacctattcatacatgggtgtggtcatcagggaaggcttcctggaggaaatgacattgaaggtgaattctaaaagatgacgataaaccaccaagtgaaggagagcttaaatgtgtttttaggcagaagaaaaaccttttgggtgaaaattttaaaacttagagaggtcccatcagtttccaactgcgatgatccattctctccaccactgcccttgggcccagcccaatttaggtccaccatgcccagaggcatgaatttaacttatgacactcttgtggtggaataatggctttgggcttatgtagccatgtgtcatttttttagagatacaaattgaaatatttggggtgagatgtcatggtgtctactggcctctaaaacttcagtgaaaacatttactttcactgaaatgtcaataaatcataaattggatgtatatgttttagttggaggaaatataaaccactaaatctaggtgatgcatatttattatactcttctctctgcttttttgtacgcttgtaaaattgtatttaaaagaataagacacacttggccgggcgcggtggctcacgcctgtaatcccagcactttgggagaccgaggtgggtggatcatgaggtcaggagttcaagaccagcctggccaacatggtaaaactccatcactacatacaaaaattagccaggcattttggcgggcacctgtaatctcagctacttgggaggctgaagcaggagaattgcttgaacccgggaagcagaggttgcagtgagccaagatcacgccactgcactctagcctgggcaacagagcaagactccatctccagaaaaaaaaaaaaaaaaagacacactcacatgcaccctccatttctttcatttctagggtattctcccaacagaaatgagcccttaactgggaattctggtaagtctcaaagaagccccagcccagggtagggagggggtagcctgatggtgctttgccttgtccaagagcaccaggcacacagagtcttggatgaggatcaaaattgccaacccatggcaaagactattgaggcatagtaaagggatagcagggatcctggctttctgggggcccagtttttgggggcatcagaggcatgaggtgttgagccactaagctctcttccccaggggctgtgcccatcctcaggccacatagggtccaagaaggagccctgggacgtggcaggaggtggctcaccccagcccttgtctccccagaccttcccttctgggctgtcatcctcatcggcttggcaggactcctgggagtcatcacatgcctgatctgcggtgtcctggtgagcaaggaagggttgcttgtcttcttaacaattgggttgtaagagttcttaatatattataaaaccatactatactatacacaagtcctttgctggatatatgttttgcaaatattttctcccagttcacggagtggctttcctattttctttttataattttatttttaattaattgacaaataatgaatgcatatatttaggggatacaatgtgatgctttggtatatgtacaattatggaatgactcaatcaagctaattaatatgtccctcacctctcatacttattatttctttgtggtgtgaacattggcaacctatactcttagcaattttgaaatctacattattattaactatagttactatgttatgcagatctcaaaaacttcacaacctatatgctgattacaagatattgagagaaaaagtgattgcaaagagtgtaaataaaataatgtaagagggaaaaatgtaacaaaattagtcgttagggaaatgtacacggaagtcacaatgagaggccacttttcacaagaatggataaaattgaaaagattgactataacaagtgttggtgaaaatgtgacagaactggaactctcataaagtgaaagtggaaaatagcttggccatttctttgaaaattacacacacctaccgtaagacctaccatcccactactagtaatttatctaagagaaataaaaacatatgtctatatgaagacttgtacacaagtaaatgttcataacagctttgtttgtaatagccaaactctgaaaacaagcccctaatgtccattaacaaatatatcctgacaatggaatattattcagcaacaaaaaggaattattaatacattaataaattatacagcaacatgtataaattgcaaaatagttatgcctagtgaaagaatccagatgaagaaaagagtacatgccatatgattcccttaatagacaaattctagaaaatacaaactaatctgtaaggacaggaatcagatcagcggttgcctgggaatgaaaatgtgtttgcagtggcagggaaaaaggaattgtaaaagagcaggaagaaagtttttttgttgttttttttttgttttttcttgagacagagtcttagtctatcgcccaagctggagtgcaatggcacgatctcagctcattgcaacctctgcctctcgggttcaagcgtttttcctgccccagcctcccaagtagctgggattacacatgcgcaccaccacactcagctaatttttgtatttttagtagagacggggttttaccatgttggccaggctggtctcgaactcctgacctcaggtgatccacccgccttggcctcccaaagtgctgggattacaggagtgagccaccatgcctggccaggacgaaagttttggggatgatggatggatgttccttatgttgattgtggtgacgattcaataagttatgatcagaacttatcaaaacattcactttaaatgtgtgcagtttattttatgtcagttatgcctcagttaagctggacagatgtagaggaggaagggagggagagagggggctgagatcaggaccaaaagccagagagaaagagactgagaatgagatgagagagaaatggtatttagacagaagacaggcgatagatgattgatagttgacagatgattggtggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaggtttaaacaaaacgcaattatgttgaaatgacaatgattgtggatataaaggtagatagaaatagatatttgtgaagataatggttagataaaaatgataggtaacagatattgatagatcttgataagtagatgataaatacatgattgatggatgacaggtgattgatagatgatttgatggattataaataggagatgattgagaggtgagagataattgatggttatttgattggtagataattgattgacaggttgataaatattgatagctagatgatagataaatagatcattggtagatatgtgatatattgataaagaaattcagaggcaaaaggagagagaaatgaaggggatatcggagggggaaaaatttttttaaaccgagagtgaaacaaggagacagaagaaaagaaagtggtgaaaagaggaaaagaactgagggagaaattaaatgaaacaatgaagggagacagaggaagcataaggcctctggctttggccatattctcacccctgtggtctcctctccctggacggctgaccagtccattctcacgcctcctcctcaccctcataggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcgg

SEQ ID NO: 314 - DNA, 66765 bp, Homo sapiens
  misc_feature (38757)..(38757): n is a, c, g, or t
  misc_feature (38775)..(38775): n is a, c, g, or t
  misc_feature (38778)..(38778): n is a, c, g, or t
  misc_feature (38835)..(38835): n is a, c, g, or t
  misc_feature (38838)..(38838): n is a, c, g, or t
  misc_feature (38859)..(38859): n is a, c, g, or t
  misc_feature (38868)..(38868): n is a, c, g, or t
  misc_feature (38883)..(38883): n is a, c, g, or t
  misc_feature (38892)..(38892): n is a, c, g, or t
  misc_feature (41833)..(41833): n is a, c, g, or t
  misc_feature (41838)..(41838): n is a, c, g, or t
  misc_feature (41843)..(41843): n is a, c, g, or t
  misc_feature (41847)..(41847): n is a, c, g, or t
  misc_feature (41859)..(41859): n is a, c, g, or t
  misc_feature (41865)..(41865): n is a, c, g, or t
  misc_feature (41874)..(41876): n is a, c, g, or t
  misc_feature (41881)..(41883): n is a, c, g, or t
  misc_feature (41892)..(41892): n is a, c, g, or t
  misc_feature (41911)..(41911): n is a, c, g, or t
  misc_feature (41942)..(41942): n is a, c, g, or t
  misc_feature (41945)..(41945): n is a, c, g, or t
  misc_feature (41951)..(41951): n is a, c, g, or t
  misc_feature (41986)..(41986): n is a, c, g, or t
  misc_feature (41989)..(41989): n is a, c, g, or t
  misc_feature (41991)..(41991): n is a, c, g, or t
  misc_feature (41994)..(41994): n is a, c, g, or t
  misc_feature (42000)..(42000): n is a, c, g, or t
  misc_feature (42016)..(42016): n is a, c, g, or t
  misc_feature (42022)..(42022): n is a, c, g, or t
  misc_feature (42026)..(42026): n is a, c, g, or t
  misc_feature (43909)..(43909): n is a, c, g, or t
  misc_feature (43911)..(43912): n is a, c, g, or t
  misc_feature (43916)..(43916): n is a, c, g, or t
  misc_feature (43927)..(43927): n is a, c, g, or t
  misc_feature (43929)..(43929): n is a, c, g, or t
  misc_feature (43932)..(43932): n is a, c, g, or t
  misc_feature (43939)..(43939): n is a, c, g, or t
  misc_feature (43947)..(43947): n is a, c, g, or t
  misc_feature (43965)..(43965): n is a, c, g, or t
  misc_feature (43968)..(43968): n is a, c, g, or t
  misc_feature (43970)..(43970): n is a, c, g, or t
  misc_feature (43974)..(43975): n is a, c, g, or t
  misc_feature (43982)..(43983): n is a, c, g, or t
  misc_feature (43985)..(43985): n is a, c, g, or t
  misc_feature (43989)..(43989): n is a, c, g, or t
  misc_feature (43992)..(43992): n is a, c, g, or t
  misc_feature (44013)..(44013): n is a, c, g, or t
  misc_feature (44377)..(44377): n is a, c, g, or t
  misc_feature (44379)..(44380): n is a, c, g, or t
  misc_feature (44384)..(44384): n is a, c, g, or t
  misc_feature (44395)..(44395): n is a, c, g, or t
  misc_feature (44397)..(44397): n is a, c, g, or t
  misc_feature (44400)..(44400): n is a, c, g, or t
  misc_feature (44407)..(44407): n is a, c, g, or t
  misc_feature (44415)..(44415): n is a, c, g, or t
  misc_feature (44433)..(44433): n is a, c, g, or t
  misc_feature (44436)..(44436): n is a, c, g, or t
  misc_feature (44438)..(44438): n is a, c, g, or t
  misc_feature (44442)..(44443): n is a, c, g, or t
  misc_feature (44450)..(44451): n is a, c, g, or t
  misc_feature (44453)..(44453): n is a, c, g, or t
  misc_feature (44457)..(44457): n is a, c, g, or t
  misc_feature (44460)..(44460): n is a, c, g, or t
  misc_feature (44481)..(44481): n is a, c, g, or t
  misc_feature (47185)..(47185): n is a, c, g, or t
  misc_feature (47187)..(47188): n is a, c, g, or t
  misc_feature (47192)..(47192): n is a, c, g, or t
  misc_feature (47203)..(47203): n is a, c, g, or t
  misc_feature (47205)..(47205): n is a, c, g, or t
  misc_feature (47208)..(47208): n is a, c, g, or t
  misc_feature (47215)..(47215): n is a, c, g, or t
  misc_feature (47223)..(47223): n is a, c, g, or t
  misc_feature (47241)..(47241): n is a, c, g, or t
  misc_feature (47244)..(47244): n is a, c, g, or t
  misc_feature (47246)..(47246): n is a, c, g, or t
  misc_feature (47250)..(47251): n is a, c, g, or t
  misc_feature (47258)..(47259): n is a, c, g, or t
  misc_feature (47261)..(47261): n is a, c, g, or t
  misc_feature (47265)..(47265): n is a, c, g, or t
  misc_feature (47268)..(47268): n is a, c, g, or t
  misc_feature (47289)..(47289): n is a, c, g, or t
  misc_feature (48118)..(48118): n is a, c, g, or t
  misc_feature (48120)..(48121): n is a, c, g, or t
  misc_feature (48125)..(48125): n is a, c, g, or t
  misc_feature (48136)..(48136): n is a, c, g, or t
  misc_feature (48138)..(48138): n is a, c, g, or t
  misc_feature (48141)..(48141): n is a, c, g, or t
  misc_feature (48148)..(48148): n is a, c, g, or t
  misc_feature (48156)..(48156): n is a, c, g, or t
  misc_feature (48174)..(48174): n is a, c, g, or t
  misc_feature (48177)..(48177): n is a, c, g, or t
  misc_feature (48179)..(48179): n is a, c, g, or t
  misc_feature (48183)..(48184): n is a, c, g, or t
  misc_feature (48191)..(48192): n is a, c, g, or t
  misc_feature (48194)..(48194): n is a, c, g, or t
  misc_feature (48198)..(48198): n is a, c, g, or t
  misc_feature (48201)..(48201): n is a, c, g, or t
  misc_feature (48222)..(48222): n is a, c, g, or t
  misc_feature (48226)..(48226): n is a, c, g, or t
  misc_feature (48228)..(48228): n is a, c, g, or t
  misc_feature (48231)..(48231): n is a, c, g, or t
  misc_feature (48246)..(48249): n is a, c, g, or t
  misc_feature (48253)..(48253): n is a, c, g, or t
  misc_feature (48255)..(48255): n is a, c, g, or t
  misc_feature (48265)..(48265): n is a, c, g, or t
  misc_feature (48273)..(48273): n is a, c, g, or t
  misc_feature (48278)..(48278): n is a, c, g, or t
  misc_feature (48305)..(48306): n is a, c, g, or t
  misc_feature (48313)..(48313): n is a, c, g, or t
  misc_feature (48315)..(48315): n is a, c, g, or t
  misc_feature (48322)..(48322): n is a, c, g, or t
  misc_feature (48327)..(48327): n is a, c, g, or t
  misc_feature (48340)..(48340): n is a, c, g, or t
  misc_feature (48356)..(48356): n is a, c, g, or t
  misc_feature (48362)..(48363): n is a, c, g, or t
  misc_feature (48365)..(48365): n is a, c, g, or t
  misc_feature (48367)..(48367): n is a, c, g, or t
  misc_feature (48369)..(48369): n is a, c, g, or t
  misc_feature (48378)..(48378): n is a, c, g, or t
  misc_feature (48388)..(48388): n is a, c, g, or t
  misc_feature (48393)..(48393): n is a, c, g, or t
  misc_feature (48398)..(48398): n is a, c, g, or t
  misc_feature (48402)..(48402): n is a, c, g, or t
  misc_feature (48414)..(48414): n is a, c, g, or t
  misc_feature (48420)..(48420): n is a, c, g, or t
  misc_feature (48429)..(48431): n is a, c, g, or t
  misc_feature (48436)..(48438): n is a, c, g, or t
  misc_feature (48447)..(48447): n is a, c, g, or t
  misc_feature (48466)..(48466): n is a, c, g, or t
  misc_feature (49006)..(49006): n is a, c, g, or t
  misc_feature (49009)..(49009): n is a, c, g, or t
  misc_feature (49011)..(49011): n is a, c, g, or t
  misc_feature (49014)..(49014): n is a, c, g, or t
  misc_feature (49020)..(49020): n is a, c, g, or t
  misc_feature (49036)..(49036): n is a, c, g, or t
  misc_feature (49042)..(49042): n is a, c, g, or t
  misc_feature (49046)..(49046): n is a, c, g, or t
  misc_feature (49321)..(49321): n is a, c, g, or t
  misc_feature (49326)..(49326): n is a, c, g, or t
  misc_feature (49331)..(49331): n is a, c, g, or t
  misc_feature (49335)..(49335): n is a, c, g, or t
  misc_feature (49347)..(49347): n is a, c, g, or t
  misc_feature (49353)..(49353): n is a, c, g, or t
  misc_feature (49362)..(49364): n is a, c, g, or t
  misc_feature (49369)..(49371): n is a, c, g, or t
  misc_feature (49380)..(49380): n is a, c, g, or t
  misc_feature (49399)..(49399): n is a, c, g, or t
  misc_feature (49430)..(49430): n is a, c, g, or t
  misc_feature (49433)..(49433): n is a, c, g, or t
  misc_feature (49439)..(49439): n is a, c, g, or t
  misc_feature (49474)..(49474): n is a, c, g, or t
  misc_feature (49477)..(49477): n is a, c, g, or t
  misc_feature (49479)..(49479): n is a, c, g, or t
  misc_feature (49482)..(49482): n is a, c, g, or t
  misc_feature (49488)..(49488): n is a, c, g, or t
  misc_feature (49504)..(49504): n is a, c, g, or t
  misc_feature (49510)..(49510): n is a, c, g, or t
  misc_feature (49514)..(49514): n is a, c, g, or t
  misc_feature (49519)..(49519): n is a, c, g, or t
  misc_feature (49521)..(49522): n is a, c, g, or t
  misc_feature (49526)..(49526): n is a, c, g, or t
  misc_feature (49537)..(49537): n is a, c, g, or t
  misc_feature (49539)..(49539): n is a, c, g, or t
  misc_feature (49542)..(49542): n is a, c, g, or t
  misc_feature (49549)..(49549): n is a, c, g, or t
  misc_feature (49557)..(49557): n is a, c, g, or t
  misc_feature (49575)..(49575): n is a, c, g, or t
  misc_feature (49578)..(49578): n is a, c, g, or t
  misc_feature (49580)..(49580): n is a, c, g, or t
  misc_feature (49584)..(49585): n is a, c, g, or t
  misc_feature (49592)..(49593): n is a, c, g, or t
  misc_feature (49595)..(49595): n is a, c, g, or t
  misc_feature (49599)..(49599): n is a, c, g, or t
  misc_feature (49602)..(49602): n is a, c, g, or t
  misc_feature (49623)..(49623): n is a, c, g, or t
  misc_feature (50725)..(50725): n is a, c, g, or t
  misc_feature (50730)..(50730): n is a, c, g, or t
  misc_feature (50735)..(50735): n is a, c, g, or t
  misc_feature (50739)..(50739): n is a, c, g, or t
  misc_feature (50751)..(50751): n is a, c, g, or t
  misc_feature (50757)..(50757): n is a, c, g, or t
  misc_feature (50766)..(50768): n is a, c, g, or t
  misc_feature (50773)..(50775): n is a, c, g, or t
  misc_feature (50784)..(50784): n is a, c, g, or t
  misc_feature (50803)..(50803): n is a, c, g, or t
  misc_feature (50834)..(50834): n is a, c, g, or t
  misc_feature (50837)..(50837): n is a, c, g, or t
  misc_feature (50843)..(50843): n is a, c, g, or t
  misc_feature (50878)..(50878): n is a, c, g, or t
  misc_feature (50881)..(50881): n is a, c, g, or t
  misc_feature (50883)..(50883): n is a, c, g, or t
  misc_feature (50886)..(50886): n is a, c, g, or t
  misc_feature (50892)..(50892): n is a, c, g, or t
  misc_feature (50908)..(50908): n is a, c, g, or t
  misc_feature (50914)..(50914): n is a, c, g, or t
  misc_feature (50918)..(50918): n is a, c, g, or t
  misc_feature (50923)..(50923): n is a, c, g, or t
  misc_feature (50925)..(50926): n is a, c, g, or t
  misc_feature (50930)..(50930): n is a, c, g, or t
  misc_feature (50941)..(50941): n is a, c, g, or t
  misc_feature (50943)..(50943): n is a, c, g, or t
  misc_feature (50946)..(50946): n is a, c, g, or t
  misc_feature (50953)..(50953): n is a, c, g, or t
  misc_feature (50961)..(50961): n is a, c, g, or t
  misc_feature (50979)..(50979): n is a, c, g, or t
  misc_feature (50982)..(50982): n is a, c, g, or t
  misc_feature (50984)..(50984): n is a, c, g, or t
  misc_feature (50988)..(50989): n is a, c, g, or t
  misc_feature (50996)..(50997): n is a, c, g, or t
  misc_feature (50999)..(50999): n is a, c, g, or t
  misc_feature (51003)..(51003): n is a, c, g, or t
  misc_feature (51006)..(51006): n is a, c, g, or t
  misc_feature (51027)..(51027): n is a, c, g, or t
  misc_feature (52597)..(52597): n is a, c, g, or t
  misc_feature (52602)..(52602): n is a, c, g, or t
  misc_feature (52607)..(52607): n is a, c, g, or t
  misc_feature (52611)..(52611): n is a, c, g, or t
  misc_feature (52623)..(52623): n is a, c, g, or t
  misc_feature (52629)..(52629): n is a, c, g, or t
  misc_feature (52638)..(52640): n is a, c, g, or t
  misc_feature (52645)..(52647): n is a, c, g, or t
  misc_feature (52656)..(52656): n is a, c, g, or t
  misc_feature (52675)..(52675): n is a, c, g, or t
  misc_feature (52706)..(52706): n is a, c, g, or t
  misc_feature (52709)..(52709): n is a, c, g, or t
  misc_feature (52715)..(52715): n is a, c, g, or t
  misc_feature (52750)..(52750): n is a, c, g, or t
  misc_feature (52753)..(52753): n is a, c, g, or t
  misc_feature (52755)..(52755): n is a, c, g, or t
  misc_feature (52758)..(52758): n is a, c, g, or t
  misc_feature (52764)..(52764): n is a, c, g, or t
  misc_feature (52780)..(52780): n is a, c, g, or t
  misc_feature (52786)..(52786): n is a, c, g, or t
  misc_feature (52790)..(52790): n is a, c, g, or t
  misc_feature (52795)..(52795): n is a, c, g, or t
  misc_feature (52797)..(52798): n is a, c, g, or t
  misc_feature (52802)..(52802): n is a, c, g, or t
  misc_feature (52813)..(52813): n is a, c, g, or t
  misc_feature (52815)..(52815): n is a, c, g, or t
  misc_feature (52818)..(52818): n is a, c, g, or t
  misc_feature (52825)..(52825): n is a, c, g, or t
  misc_feature (52833)..(52833): n is a, c, g, or t
  misc_feature (52851)..(52851): n is a, c, g, or t
  misc_feature (52854)..(52854): n is a, c, g, or t
  misc_feature (52856)..(52856): n is a, c, g, or t
  misc_feature (52860)..(52861): n is a, c, g, or t
  misc_feature (52868)..(52869): n is a, c, g, or t
  misc_feature (52871)..(52871): n is a, c, g, or t
  misc_feature (52875)..(52875): n is a, c, g, or t
  misc_feature (52878)..(52878): n is a, c, g, or t
  misc_feature (52899)..(52899): n is a, c, g, or t
  misc_feature (52903)..(52903): n is a, c, g, or t
  misc_feature (52905)..(52905): n is a, c, g, or t
  misc_feature (52908)..(52908): n is a, c, g, or t
  misc_feature (52923)..(52926): n is a, c, g, or t
  misc_feature (52930)..(52930): n is a, c, g, or t
  misc_feature (52932)..(52932): n is a, c, g, or t
  misc_feature (52942)..(52942): n is a, c, g, or t
  misc_feature (52950)..(52950): n is a, c, g, or t
  misc_feature (52955)..(52955): n is a, c, g, or t
  misc_feature (52982)..(52983): n is a, c, g, or t
  misc_feature (52990)..(52990): n is a, c, g, or t
  misc_feature (52992)..(52992): n is a, c, g, or t
  misc_feature (52999)..(52999): n is a, c, g, or t
  misc_feature (53004)..(53004): n is a, c, g, or t
  misc_feature (53017)..(53017): n is a, c, g, or t
  misc_feature (53033)..(53033): n is a, c, g, or t
  misc_feature (53039)..(53040): n is a, c, g, or t
  misc_feature (53042)..(53042): n is a, c, g, or t
  misc_feature (53044)..(53044): n is a, c, g, or t
  misc_feature (53046)..(53046): n is a, c, g, or t
  misc_feature (53055)..(53055): n is a, c, g, or t
  misc_feature (53065)..(53065): n is a, c, g, or t
  misc_feature (53070)..(53070): n is a, c, g, or t
  misc_feature (53075)..(53075): n is a, c, g, or t
  misc_feature (53079)..(53079): n is a, c, g, or t
  misc_feature (53091)..(53091): n is a, c, g, or t
  misc_feature (53097)..(53097): n is a, c, g, or t
  misc_feature (53533)..(53533): n is a, c, g, or t
  misc_feature (53538)..(53538): n is a, c, g, or t
  misc_feature (53543)..(53543): n is a, c, g, or t
  misc_feature (53547)..(53547): n is a, c, g, or t
  misc_feature (53559)..(53559): n is a, c, g, or t
  misc_feature (53565)..(53565): n is a, c, g, or t
  misc_feature (53574)..(53576): n is a, c, g, or t
  misc_feature (53581)..(53583): n is a, c, g, or t
  misc_feature (53592)..(53592): n is a, c, g, or t
  misc_feature (53611)..(53611): n is a, c, g, or t
  misc_feature (53642)..(53642): n is a, c, g, or t
  misc_feature (53645)..(53645): n is a, c, g, or t
  misc_feature (53651)..(53651): n is a, c, g, or t
  misc_feature (53686)..(53686): n is a, c, g, or t
  misc_feature (53689)..(53689): n is a, c, g, or t
  misc_feature (53691)..(53691): n is a, c, g, or t
  misc_feature (53694)..(53694): n is a, c, g, or t
  misc_feature (53700)..(53700): n is a, c, g, or t
  misc_feature (53716)..(53716): n is a, c, g, or t
  misc_feature (53722)..(53722): n is a, c, g, or t
  misc_feature (53726)..(53726): n is a, c, g, or t
  misc_feature (53731)..(53731): n is a, c, g, or t
  misc_feature (53733)..(53734): n is a, c, g, or t
  misc_feature (53738)..(53738): n is a, c, g, or t
  misc_feature (53749)..(53749): n is a, c, g, or t
  misc_feature (53751)..(53751): n is a, c, g, or t
  misc_feature (53754)..(53754): n is a, c, g, or t
  misc_feature (53761)..(53761): n is a, c, g, or t
  misc_feature (53769)..(53769): n is a, c, g, or t
  misc_feature (53787)..(53787): n is a, c, g, or t
  misc_feature (53790)..(53790): n is a, c, g, or t
  misc_feature (53792)..(53792): n is a, c, g, or t
  misc_feature (53796)..(53797): n is a, c, g, or t
  misc_feature (53804)..(53805): n is a, c, g, or t
  misc_feature (53807)..(53807): n is a, c, g, or t
  misc_feature (53811)..(53811): n is a, c, g, or t
  misc_feature (53814)..(53814): n is a, c, g, or t
  misc_feature (53835)..(53835): n is a, c, g, or t
  misc_feature (53839)..(53839): n is a, c, g, or t
  misc_feature (53841)..(53841): n is a, c, g, or t
  misc_feature (53844)..(53844): n is a, c, g, or t
  misc_feature (53859)..(53862): n is a, c, g, or t
  misc_feature (53866)..(53866): n is a, c, g, or t
  misc_feature (53868)..(53868): n is a, c, g, or t
  misc_feature (53878)..(53878): n is a, c, g, or t
  misc_feature (53886)..(53886): n is a, c, g, or t
  misc_feature (53891)..(53891): n is a, c, g, or t
  misc_feature (53918)..(53919): n is a, c, g, or t
  misc_feature (53926)..(53926): n is a, c, g, or t
  misc_feature (53928)..(53928): n is a, c, g, or t
  misc_feature (53935)..(53935): n is a, c, g, or t
  misc_feature (53940)..(53940): n is a, c, g, or t
  misc_feature (53953)..(53953): n is a, c, g, or t
  misc_feature (53969)..(53969): n is a, c, g, or t
  misc_feature (53975)..(53976): n is a, c, g, or t
  misc_feature (53978)..(53978): n is a, c, g, or t
  misc_feature (53980)..(53980): n is a, c, g, or t
  misc_feature (53982)..(53982): n is a, c, g, or t
  misc_feature (53991)..(53991): n is a, c, g, or t
  misc_feature (54001)..(54001): n is a, c, g, or t
  misc_feature (54006)..(54006): n is a, c, g, or t
  misc_feature (54011)..(54011): n is a, c, g, or t
  misc_feature (54015)..(54015): n is a, c, g, or t
  misc_feature (54027)..(54027): n is a, c, g, or t
  misc_feature (54033)..(54033): n is a, c, g, or t
  misc_feature (54042)..(54044): n is a, c, g, or t
  misc_feature (54049)..(54051): n is a, c, g, or t
  misc_feature (54060)..(54060): n is a, c, g, or t
  misc_feature (54079)..(54079): n is a, c, g, or t
  misc_feature (54469)..(54469): n is a, c, g, or t
  misc_feature (54474)..(54474): n is a, c, g, or t
  misc_feature (54479)..(54479): n is a, c, g, or t
  misc_feature (54483)..(54483): n is a, c, g, or t
  misc_feature (54495)..(54495): n is a, c, g, or t
  misc_feature (54501)..(54501): n is a, c, g, or t
  misc_feature (54510)..(54512): n is a, c, g, or t
  misc_feature (54517)..(54519): n is a, c, g, or t
  misc_feature (54528)..(54528): n is a, c, g, or t
  misc_feature (54547)..(54547): n is a, c, g, or t
  misc_feature (54578)..(54578): n is a, c, g, or t
  misc_feature (54581)..(54581): n is a, c, g, or t
  misc_feature (54587)..(54587): n is a, c, g, or t
  misc_feature (54622)..(54622): n is a, c, g, or t
  misc_feature (54625)..(54625): n is a, c, g, or t
  misc_feature (54627)..(54627): n is a, c, g, or t
  misc_feature (54630)..(54630): n is a, c, g, or t
  misc_feature (54636)..(54636): n is a, c, g, or t
  misc_feature (54652)..(54652): n is a, c, g, or t
  misc_feature (54658)..(54658): n is a, c, g, or t
  misc_feature (54662)..(54662): n is a, c, g, or t
  misc_feature (54667)..(54667): n is a, c, g, or t
  misc_feature (54669)..(54670): n is a, c, g, or t
  misc_feature (54674)..(54674): n is a, c, g, or t
  misc_feature (54685)..(54685): n is a, c, g, or t
  misc_feature (54687)..(54687): n is a, c, g, or t
  misc_feature (54690)..(54690): n is a, c, g, or t
  misc_feature (54697)..(54697): n is a, c, g, or t
  misc_feature (54705)..(54705): n is a, c, g, or t
  misc_feature (54723)..(54723): n is a, c, g, or t
  misc_feature (54726)..(54726): n is a, c, g, or t
  misc_feature (54728)..(54728): n is a, c, g, or t
  misc_feature (54732)..(54733): n is a, c, g, or t
  misc_feature (54740)..(54741): n is a, c, g, or t
  misc_feature (54743)..(54743): n is a, c, g, or t
  misc_feature (54747)..(54747): n is a, c, g, or t
  misc_feature (54750)..(54750): n is a, c, g, or t
  misc_feature (54771)..(54771): n is a, c, g, or t
  misc_feature (54775)..(54775): n is a, c, g, or t
  misc_feature (54777)..(54777): n is a, c, g, or t
  misc_feature (54780)..(54780): n is a, c, g, or t
  misc_feature (54795)..(54798): n is a, c, g, or t
  misc_feature (54802)..(54802): n is a, c, g, or t
  misc_feature (54804)..(54804): n is a, c, g, or t
  misc_feature (54814)..(54814): n is a, c, g, or t
  misc_feature (54822)..(54822): n is a, c, g, or t
  misc_feature (54827)..(54827): n is a, c, g, or t
  misc_feature (54854)..(54855): n is a, c, g, or t
  misc_feature (54862)..(54862): n is a, c, g, or t
  misc_feature (54864)..(54864): n is a, c, g, or t
  misc_feature (54871)..(54871): n is a, c, g, or t
  misc_feature (54876)..(54876): n is a, c, g, or t
  misc_feature (54889)..(54889): n is a, c, g, or t
  misc_feature (54905)..(54905): n is a, c, g, or t
  misc_feature (54911)..(54912): n is a, c, g, or t
  misc_feature (54914)..(54914): n is a, c, g, or t
  misc_feature (54916)..(54916): n is a, c, g, or t
  misc_feature (54918)..(54918): n is a, c, g, or t
  misc_feature (54927)..(54927): n is a, c, g, or t
  misc_feature (54937)..(54937): n is a, c, g, or t
  misc_feature (54942)..(54942): n is a, c, g, or t
  misc_feature (54947)..(54947): n is a, c, g, or t
  misc_feature (54951)..(54951): n is a, c, g, or t
  misc_feature (54963)..(54963): n is a, c, g, or t
  misc_feature (54969)..(54969): n is a, c, g, or t
  misc_feature (54978)..(54980): n is a, c, g, or t
  misc_feature (54985)..(54987): n is a, c, g, or t
  misc_feature (54996)..(54996): n is a, c, g, or t
  misc_feature (55015)..(55015): n is a, c, g, or t
  misc_feature (55405)..(55405): n is a, c, g, or t
  misc_feature (55410)..(55410): n is a, c, g, or t
  misc_feature (55415)..(55415): n is a, c, g, or t
  misc_feature (55419)..(55419): n is a, c, g, or t
  misc_feature (55431)..(55431): n is a, c, g, or t
  misc_feature (55437)..(55437): n is a, c, g, or t
  misc_feature (55446)..(55448): n is a, c, g, or t
  misc_feature (55453)..(55455): n is a, c, g, or t
  misc_feature (55464)..(55464): n is a, c, g, or t
  misc_feature (55483)..(55483): n is a, c, g, or t
  misc_feature (55514)..(55514): n is a, c, g, or t
  misc_feature (55517)..(55517): n is a, c, g, or t
  misc_feature (55523)..(55523): n is a, c, g, or t
  misc_feature (55558)..(55558): n is a, c, g, or t
  misc_feature (55561)..(55561): n is a, c, g, or t
  misc_feature (55563)..(55563): n is a, c, g, or t
  misc_feature (55566)..(55566): n is a, c, g, or t
  misc_feature (55572)..(55572): n is a, c, g, or t
  misc_feature (55588)..(55588): n is a, c, g, or t
  misc_feature (55594)..(55594): n is a, c, g, or t
  misc_feature (55598)..(55598): n is a, c, g, or t
  misc_feature (55603)..(55603): n is a, c, g, or t
  misc_feature (55605)..(55606): n is a, c, g, or t
  misc_feature (55610)..(55610): n is a, c, g, or t
  misc_feature (55621)..(55621): n is a, c, g, or t
  misc_feature (55623)..(55623): n is a, c, g, or t
  misc_feature (55626)..(55626): n is a, c, g, or t
  misc_feature (55633)..(55633): n is a, c, g, or t
  misc_feature (55641)..(55641): n is a, c, g, or t
  misc_feature (55659)..(55659): n is a, c, g, or t
  misc_feature (55662)..(55662): n is a, c, g, or t
  misc_feature (55664)..(55664): n is a, c, g, or t
  misc_feature (55668)..(55669): n is a, c, g, or t
  misc_feature (55676)..(55677): n is a, c, g, or t
  misc_feature (55679)..(55679): n is a, c, g, or t
  misc_feature (55683)..(55683): n is a, c, g, or t
  misc_feature (55686)..(55686): n is a, c, g, or t
  misc_feature (55707)..(55707): n is a, c, g, or t
  misc_feature (55711)..(55711): n is a, c, g, or t
  misc_feature (55713)..(55713): n is a, c, g, or t
  misc_feature (55716)..(55716): n is a, c, g, or t
  misc_feature (55731)..(55734): n is a, c, g, or t
  misc_feature (55738)..(55738): n is a, c, g, or t
  misc_feature (55740)..(55740): n is a, c, g, or t
  misc_feature (55750)..(55750): n is a, c, g, or t
  misc_feature (55758)..(55758): n is a, c, g, or t
  misc_feature (55763)..(55763): n is a, c, g, or t
  misc_feature (55790)..(55791): n is a, c, g, or t
  misc_feature (55798)..(55798): n is a, c, g, or t
  misc_feature (55800)..(55800): n is a, c, g, or t
  misc_feature (55807)..(55807): n is a, c, g, or t
  misc_feature (55812)..(55812): n is a, c, g, or t
  misc_feature (55825)..(55825): n is a, c, g, or t
  misc_feature (55841)..(55841): n is a, c, g, or t
  misc_feature (55847)..(55848): n is a, c, g, or t
  misc_feature (55850)..(55850): n is a, c, g, or t
  misc_feature (55852)..(55852): n is a, c, g, or t
  misc_feature (55854)..(55854): n is a, c, g, or t
  misc_feature (55863)..(55863): n is a, c, g, or t
  misc_feature (55873)..(55873): n is a, c, g, or t
  misc_feature (55878)..(55878): n is a, c, g, or t
  misc_feature (55883)..(55883): n is a, c, g, or t
  misc_feature (55887)..(55887): n is a, c, g, or t
  misc_feature (55899)..(55899): n is a, c, g, or t
  misc_feature (55905)..(55905): n is a, c, g, or t
  misc_feature (55914)..(55916): n is a, c, g, or t
  misc_feature (55921)..(55923): n is a, c, g, or t
  misc_feature (55932)..(55932): n is a, c, g, or t
  misc_feature (55951)..(55951): n is a, c, g, or t
  misc_feature (56341)..(56341): n is a, c, g, or t
  misc_feature (56346)..(56346): n is a, c, g, or t
  misc_feature (56351)..(56351): n is a, c, g, or t
  misc_feature (56355)..(56355): n is a, c, g, or t
  misc_feature (56367)..(56367): n is a, c, g, or t
  misc_feature (56373)..(56373): n is a, c, g, or t
  misc_feature (56382)..(56384): n is a, c, g, or t
  misc_feature (56389)..(56391): n is a, c, g, or t
  misc_feature (56400)..(56400): n is a, c, g, or t
  misc_feature (56419)..(56419): n is a, c, g, or t
  misc_feature (56450)..(56450): n is a, c, g, or t
  misc_feature (56453)..(56453): n is a, c, g, or t
  misc_feature (56459)..(56459): n is a, c, g, or t
  misc_feature (56494)..(56494): n is a, c, g, or t
  misc_feature (56497)..(56497): n is a, c, g, or t
  misc_feature (56499)..(56499): n is a, c, g, or t
  misc_feature (56502)..(56502): n is a, c, g, or t
  misc_feature (56508)..(56508): n is a, c, g, or t
  misc_feature (56524)..(56524): n is a, c, g, or t
  misc_feature (56530)..(56530): n is a, c, g, or t
  misc_feature (56534)..(56534): n is a, c, g, or t
  misc_feature (56539)..(56539): n is a, c, g, or t
  misc_feature (56541)..(56542): n is a, c, g, or t
  misc_feature (56546)..(56546): n is a, c, g, or t
  misc_feature (56557)..(56557): n is a, c, g, or t
  misc_feature (56559)..(56559): n is a, c, g, or t
  misc_feature (56562)..(56562): n is a, c, g, or t
  misc_feature (56569)..(56569): n is a, c, g, or t
  misc_feature (56577)..(56577): n is a, c, g, or t
  misc_feature (56595)..(56595): n is a, c, g, or t
  misc_feature (56598)..(56598): n is a, c, g, or t
  misc_feature (56600)..(56600): n is a, c, g, or t
  misc_feature (56604)..(56605): n is a, c, g, or t
  misc_feature (56612)..(56613): n is a, c, g, or t
  misc_feature (56615)..(56615): n is a, c, g, or t
  misc_feature (56619)..(56619): n is a, c, g, or t
  misc_feature (56622)..(56622): n is a, c, g, or t
  misc_feature (56643)..(56643): n is a, c, g, or t
  misc_feature (56647)..(56647): n is a, c, g, or t
  misc_feature (56649)..(56649): n is a, c, g, or t
  misc_feature (56652)..(56652): n is a, c, g, or t
  misc_feature (56667)..(56670): n is a, c, g, or t
  misc_feature (56674)..(56674): n is a, c, g, or t
  misc_feature (56676)..(56676): n is a, c, g, or t
  misc_feature (56686)..(56686): n is a, c, g, or t
  misc_feature (56694)..(56694): n is a, c, g, or t
  misc_feature (56699)..(56699): n is a, c, g, or t
  misc_feature (56726)..(56727): n is a, c, g, or t
  misc_feature (56734)..(56734): n is a, c, g, or t
  misc_feature (56736)..(56736): n is a, c, g, or t
  misc_feature (56743)..(56743): n is a, c, g, or t
  misc_feature (56748)..(56748): n is a, c, g, or t
  misc_feature (56761)..(56761): n is a, c, g, or t
  misc_feature (56777)..(56777): n is a, c, g, or t
  misc_feature (56783)..(56784): n is a, c, g, or t
  misc_feature (56786)..(56786): n is a, c, g, or t
  misc_feature (56788)..(56788): n is a, c, g, or t
  misc_feature (56790)..(56790): n is a, c, g, or t
  misc_feature (56799)..(56799): n is a, c, g, or t
  misc_feature (56809)..(56809): n is a, c, g, or t
  misc_feature (56814)..(56814): n is a, c, g, or t
  misc_feature (56819)..(56819): n is a, c, g, or t
  misc_feature (56823)..(56823): n is a, c, g, or t
  misc_feature (56835)..(56835): n is a, c, g, or t
  misc_feature (56841)..(56841): n is a, c, g, or t
  misc_feature (56850)..(56852): n is a, c, g, or t
  misc_feature (56857)..(56859): n is a, c, g, or t
  misc_feature (56868)..(56868): n is a, c, g, or t
  misc_feature (56887)..(56887): n is a, c, g, or t
  misc_feature (57475)..(57475): n is a, c, g, or t
  misc_feature (57477)..(57478): n is a, c, g, or t
  misc_feature (57482)..(57482): n is a, c, g, or t
  misc_feature (57493)..(57493): n is a, c, g, or t
  misc_feature (57495)..(57495): n is a, c, g, or t
  misc_feature (57498)..(57498): n is a, c, g, or t
  misc_feature (57505)..(57505): n is a, c, g, or t
  misc_feature (57513)..(57513): n is a, c, g, or t
  misc_feature (57531)..(57531): n is a, c, g, or t
  misc_feature (57534)..(57534): n is a, c, g, or t
  misc_feature (57536)..(57536): n is a, c, g, or t
  misc_feature (57540)..(57541): n is a, c, g, or t
  misc_feature (57548)..(57549): n is a, c, g, or t
  misc_feature (57551)..(57551): n is a, c, g, or t
  misc_feature (57555)..(57555): n is a, c, g, or t
  misc_feature (57558)..(57558): n is a, c, g, or t
  misc_feature (57579)..(57579): n is a, c, g, or t
  misc_feature (57583)..(57583): n is a, c, g, or t
  misc_feature (57585)..(57585): n is a, c, g, or t
  misc_feature (57588)..(57588): n is a, c, g, or t
  misc_feature (57603)..(57606): n is a, c, g, or t
  misc_feature (57610)..(57610): n is a, c, g, or t
  misc_feature (57612)..(57612): n is a, c, g, or t
  misc_feature (57622)..(57622): n is a, c, g, or t
  misc_feature (57630)..(57630): n is a, c, g, or t
  misc_feature (57635)..(57635): n is a, c, g, or t
  misc_feature (57662)..(57663): n is a, c, g, or t
  misc_feature (57670)..(57670): n is a, c, g, or t
  misc_feature (57672)..(57672): n is a, c, g, or t
  misc_feature (57679)..(57679): n is a, c, g, or t
  misc_feature (57684)..(57684): n is a, c, g, or t
  misc_feature (57697)..(57697): n is a, c, g, or t
  misc_feature (57713)..(57713): n is a, c, g, or t
  misc_feature (57719)..(57720): n is a, c, g, or t
  misc_feature (57722)..(57722): n is a, c, g, or t
  misc_feature (57724)..(57724): n is a, c, g, or t
  misc_feature (57726)..(57726): n is a, c, g, or t
  misc_feature (57735)..(57735): n is a, c, g, or t
  misc_feature (57745)..(57745): n is a, c, g, or t
  misc_feature (57750)..(57750): n is a, c, g, or t
  misc_feature (57755)..(57755): n is a, c, g, or t
  misc_feature (57759)..(57759): n is a, c, g, or t
  misc_feature (57771)..(57771): n is a, c, g, or t
  misc_feature (57777)..(57777): n is a, c, g, or t
  misc_feature (57786)..(57788): n is a, c, g, or t
  misc_feature (57793)..(57795): n is a, c, g, or t
  misc_feature (57804)..(57804): n is a, c, g, or t
  misc_feature (57823)..(57823): n is a, c, g, or t
  misc_feature (58213)..(58213): n is a, c, g, or t
  misc_feature (58218)..(58218): n is a, c, g, or t
  misc_feature (58223)..(58223): n is a, c, g, or t
  misc_feature (58227)..(58227): n is a, c, g, or t
  misc_feature (58239)..(58239): n is a, c, g, or t
  misc_feature (58245)..(58245): n is a, c, g, or t
  misc_feature (58254)..(58256): n is a, c, g, or t
  misc_feature (58261)..(58263): n is a, c, g, or t
  misc_feature (58272)..(58272): n is a, c, g, or t
  misc_feature (58291)..(58291): n is a, c, g, or t
  misc_feature (58322)..(58322): n is a, c, g, or t
  misc_feature (58325)..(58325): n is a, c, g, or t
  misc_feature (58331)..(58331): n is a, c, g, or t
  misc_feature (58366)..(58366): n is a, c, g, or t
  misc_feature (58369)..(58369): n is a, c, g, or t
  misc_feature (58371)..(58371): n is a, c, g, or t
  misc_feature (58374)..(58374): n is a, c, g, or t
  misc_feature (58380)..(58380): n is a, c, g, or t
  misc_feature (58396)..(58396): n is a, c, g, or t
  misc_feature (58402)..(58402): n is a, c, g, or t
  misc_feature (58406)..(58406): n is a, c, g, or t
  misc_feature (58411)..(58411): n is a, c, g, or t
  misc_feature (58413)..(58414): n is a, c, g, or t
  misc_feature (58418)..(58418): n is a, c, g, or t
  misc_feature (58429)..(58429): n is a, c, g, or t
  misc_feature (58431)..(58431): n is a, c, g, or t
  misc_feature (58434)..(58434): n is a, c, g, or t
  misc_feature (58441)..(58441): n is a, c, g, or t
  misc_feature (58449)..(58449): n is a, c, g, or t
  misc_feature (58467)..(58467): n is a, c, g, or t
  misc_feature (58470)..(58470): n is a, c, g, or t
  misc_feature (58472)..(58472): n is a, c, g, or t
  misc_feature (58476)..(58477): n is a, c, g, or t
  misc_feature (58484)..(58485): n is a, c, g, or t
  misc_feature (58487)..(58487): n is a, c, g, or t
  misc_feature (58491)..(58491): n is a, c, g, or t
  misc_feature (58494)..(58494): n is a, c, g, or t
  misc_feature (58515)..(58515): n is a, c, g, or t
  misc_feature (58519)..(58519): n is a, c, g, or t
  misc_feature (58521)..(58521): n is a, c, g, or t
  misc_feature (58524)..(58524): n is a, c, g, or t
  misc_feature (58539)..(58542): n is a, c, g, or t
  misc_feature (58546)..(58546): n is a, c, g, or t
  misc_feature (58548)..(58548): n is a, c, g, or t
  misc_feature (58558)..(58558): n is a, c, g, or t
  misc_feature (58566)..(58566): n is a, c, g, or t
  misc_feature (58571)..(58571): n is a, c, g, or t
  misc_feature (58598)..(58599): n is a, c, g, or t
  misc_feature (58606)..(58606): n is a, c, g, or t
  misc_feature (58608)..(58608): n is a, c, g, or t
  misc_feature (58615)..(58615): n is a, c, g, or t
  misc_feature (58620)..(58620): n is a, c, g, or t
  misc_feature (58633)..(58633): n is a, c, g, or t
  misc_feature (58649)..(58649): n is a, c, g, or t
  misc_feature (58655)..(58656): n is a, c, g, or t
  misc_feature (58658)..(58658): n is a, c, g, or t
  misc_feature (58660)..(58660): n is a, c, g, or t
  misc_feature (58662)..(58662): n is a, c, g, or t
  misc_feature (58671)..(58671): n is a, c, g, or t
  misc_feature (58681)..(58681): n is a, c, g, or t
  misc_feature (58686)..(58686): n is a, c, g, or t
  misc_feature (58691)..(58691): n is a, c, g, or t
  misc_feature (58695)..(58695): n is a, c, g, or t
  misc_feature (58707)..(58707): n is a, c, g, or t
  misc_feature (58713)..(58713): n is a, c, g, or t
  misc_feature (58722)..(58724): n is a, c, g, or t
  misc_feature (58729)..(58731): n is a, c, g, or t
  misc_feature (58740)..(58740): n is a, c, g, or t
  misc_feature (58759)..(58759): n is a, c, g, or t
  misc_feature (59149)..(59149): n is a, c, g, or t
  misc_feature (59154)..(59154): n is a, c, g, or t
  misc_feature (59159)..(59159): n is a, c, g, or t
  misc_feature (59163)..(59163): n is a, c, g, or t
  misc_feature (59175)..(59175): n is a, c, g, or t
  misc_feature (59181)..(59181): n is a, c, g, or t
  misc_feature (59190)..(59192): n is a, c, g, or t
  misc_feature (59197)..(59199): n is a, c, g, or t
  misc_feature (59208)..(59208): n is a, c, g, or t
  misc_feature (59227)..(59227): n is a, c, g, or t
  misc_feature (59258)..(59258): n is a, c, g, or t
  misc_feature (59261)..(59261): n is a, c, g, or t
  misc_feature (59267)..(59267): n is a, c, g, or t
  misc_feature (59302)..(59302): n is a, c, g, or t
  misc_feature (59305)..(59305): n is a, c, g, or t
  misc_feature (59307)..(59307): n is a, c, g, or t
  misc_feature (59310)..(59310): n is a, c, g, or t
  misc_feature (59316)..(59316): n is a, c, g, or t
  misc_feature (59332)..(59332): n is a, c, g, or t
  misc_feature (59338)..(59338): n is a, c, g, or t
  misc_feature (59342)..(59342): n is a, c, g, or t
  misc_feature (59347)..(59347): n is a, c, g, or t
  misc_feature (59349)..(59350): n is a, c, g, or t
  misc_feature (59354)..(59354): n is a, c, g, or t
  misc_feature (59365)..(59365): n is a, c, g, or t
  misc_feature (59367)..(59367): n is a, c, g, or t
  misc_feature (59370)..(59370): n is a, c, g, or t
  misc_feature (59377)..(59377): n is a, c, g, or t
  misc_feature (59385)..(59385): n is a, c, g, or t
  misc_feature (59403)..(59403): n is a, c, g, or t
  misc_feature (59406)..(59406): n is a, c, g, or t
  misc_feature (59408)..(59408): n is a, c, g, or t
  misc_feature (59412)..(59413): n is a, c, g, or t
  misc_feature (59420)..(59421): n is a, c, g, or t
  misc_feature (59423)..(59423): n is a, c, g, or t
  misc_feature (59427)..(59427): n is a, c, g, or t
  misc_feature (59430)..(59430): n is a, c, g, or t
  misc_feature (59451)..(59451): n is a, c, g, or t
  misc_feature (59455)..(59455): n is a, c, g, or t
  misc_feature (59457)..(59457): n is a, c, g, or t
  misc_feature (59460)..(59460): n is a, c, g, or t
  misc_feature (59475)..(59478): n is a, c, g, or t
  misc_feature (59482)..(59482): n is a, c, g, or t
  misc_feature (59484)..(59484): n is a, c, g, or t
  misc_feature (59494)..(59494): n is a, c, g, or t
  misc_feature (59502)..(59502): n is a, c, g, or t
  misc_feature (59507)..(59507): n is a, c, g, or t
  misc_feature (59534)..(59535): n is a, c, g, or t
  misc_feature (59542)..(59542): n is a, c, g, or t
  misc_feature (59544)..(59544): n is a, c, g, or t
  misc_feature (59551)..(59551): n is a, c, g, or t
  misc_feature (59556)..(59556): n is a, c, g, or t
  misc_feature (59569)..(59569): n is a, c, g, or t
  misc_feature (59585)..(59585): n is a, c, g, or t
  misc_feature (59591)..(59592): n is a, c, g, or t
  misc_feature (59594)..(59594): n is a, c, g, or t
  misc_feature (59596)..(59596): n is a, c, g, or t
  misc_feature (59598)..(59598): n is a, c, g, or t
  misc_feature (59607)..(59607): n is a, c, g, or t
  misc_feature (59617)..(59617): n is a, c, g, or t
  misc_feature (59622)..(59622): n is a, c, g, or t
  misc_feature (59627)..(59627): n is a, c, g, or t
  misc_feature (59631)..(59631): n is a, c, g, or t
  misc_feature (59643)..(59643): n is a, c, g, or t
  misc_feature (59649)..(59649): n is a, c, g, or t
  misc_feature (59658)..(59660): n is a, c, g, or t
  misc_feature (59665)..(59667): n is a, c, g, or t
  misc_feature (59676)..(59676): n is a, c, g, or t
  misc_feature (59695)..(59695): n is a, c, g, or t
  misc_feature (60082)..(60082): n is a, c, g, or t
  misc_feature (60087)..(60087): n is a, c, g, or t
  misc_feature (60092)..(60092): n is a, c, g, or t
  misc_feature (60096)..(60096): n is a, c, g, or t
  misc_feature (60108)..(60108): n is a, c, g, or t
  misc_feature (60114)..(60114): n is a, c, g, or t
  misc_feature (60123)..(60125): n is a, c, g, or t
  misc_feature (60130)..(60132): n is a, c, g, or t
  misc_feature (60141)..(60141): n is a, c, g, or t
  misc_feature (60160)..(60160): n is a, c, g, or t
  misc_feature (60191)..(60191): n is a, c, g, or t
  misc_feature (60194)..(60194): n is a, c, g, or t
  misc_feature (60200)..(60200): n is a, c, g, or t
  misc_feature (60235)..(60235): n is a, c, g, or t
  misc_feature (60238)..(60238): n is a, c, g, or t
  misc_feature (60240)..(60240): n is a, c, g, or t
  misc_feature (60243)..(60243): n is a, c, g, or t
  misc_feature (60249)..(60249): n is a, c, g, or t
  misc_feature (60265)..(60265): n is a, c, g, or t
  misc_feature (60271)..(60271): n is a, c, g, or t
  misc_feature (60275)..(60275): n is a, c, g, or t
  misc_feature (60280)..(60280): n is a, c, g, or t
  misc_feature (60282)..(60283): n is a, c, g, or t
  misc_feature (60287)..(60287): n is a, c, g, or t
  misc_feature (60298)..(60298): n is a, c, g, or t
  misc_feature (60300)..(60300): n is a, c, g, or t
  misc_feature (60303)..(60303): n is a, c, g, or t
  misc_feature (60310)..(60310): n is a, c, g, or t
  misc_feature (60318)..(60318): n is a, c, g, or t
  misc_feature (60336)..(60336): n is a, c, g, or t
  misc_feature (60339)..(60339): n is a, c, g, or t
  misc_feature (60341)..(60341): n is a, c, g, or t
  misc_feature (60345)..(60346): n is a, c, g, or t
  misc_feature (60353)..(60354): n is a, c, g, or t
  misc_feature (60356)..(60356): n is a, c, g, or t
  misc_feature (60360)..(60360): n is a, c, g, or t
  misc_feature (60363)..(60363): n is a, c, g, or t
  misc_feature (60384)..(60384): n is a, c, g, or t
  misc_feature (60388)..(60388): n is a, c, g, or t
  misc_feature (60390)..(60390): n is a, c, g, or t
  misc_feature (60393)..(60393): n is a, c, g, or t
  misc_feature (60408)..(60411): n is a, c, g, or t
  misc_feature (60415)..(60415): n is a, c, g, or t
  misc_feature (60417)..(60417): n is a, c, g, or t
  misc_feature (60427)..(60427): n is a, c, g, or t
  misc_feature (60435)..(60435): n is a, c, g, or t
  misc_feature (60440)..(60440): n is a, c, g, or t
  misc_feature (60467)..(60468): n is a, c, g, or t
  misc_feature (60475)..(60475): n is a, c, g, or t
  misc_feature (60477)..(60477): n is a, c, g, or t
  misc_feature (60484)..(60484): n is a, c, g, or t
  misc_feature (60489)..(60489): n is a, c, g, or t
  misc_feature (60502)..(60502): n is a, c, g, or t
  misc_feature (60518)..(60518): n is a, c, g, or t
  misc_feature (60524)..(60525): n is a, c, g, or t
  misc_feature (60527)..(60527): n is a, c, g, or t
  misc_feature (60529)..(60529): n is a, c, g, or t
  misc_feature (60531)..(60531): n is a, c, g, or t
  misc_feature (60540)..(60540): n is a, c, g, or t
  misc_feature (60550)..(60550): n is a, c, g, or t
  misc_feature (60555)..(60555): n is a, c, g, or t
  misc_feature (60560)..(60560): n is a, c, g, or t
  misc_feature (60564)..(60564): n is a, c, g, or t
  misc_feature (60576)..(60576): n is a, c, g, or t
  misc_feature (60582)..(60582): n is a, c, g, or t
  misc_feature (60591)..(60593): n is a, c, g, or t
  misc_feature (60598)..(60600): n is a, c, g, or t
  misc_feature (60609)..(60609): n is a, c, g, or t
  misc_feature (60628)..(60628): n is a, c, g, or t
  misc_feature (61018)..(61018): n is a, c, g, or t
  misc_feature (61023)..(61023): n is a, c, g, or t
  misc_feature (61028)..(61028): n is a, c, g, or t
  misc_feature (61032)..(61032): n is a, c, g, or t
  misc_feature (61044)..(61044): n is a, c, g, or t
  misc_feature (61050)..(61050): n is a, c, g, or t
  misc_feature (61059)..(61061): n is a, c, g, or t
  misc_feature (61066)..(61068): n is a, c, g, or t
  misc_feature (61077)..(61077): n is a, c, g, or t
  misc_feature (61096)..(61096): n is a, c, g, or t
  misc_feature (61127)..(61127): n is a, c, g, or t
  misc_feature (61130)..(61130): n is a, c, g, or t
  misc_feature (61136)..(61136): n is a, c, g, or t
  misc_feature (61171)..(61171): n is a, c, g, or t
  misc_feature (61174)..(61174): n is a, c, g, or t
  misc_feature (61176)..(61176): n is a, c, g, or t
  misc_feature (61179)..(61179): n is a, c, g, or t
  misc_feature (61185)..(61185): n is a, c, g, or t
  misc_feature (61201)..(61201): n is a, c, g, or t
  misc_feature (61207)..(61207): n is a, c, g, or t
  misc_feature (61211)..(61211): n is a, c, g, or t
  misc_feature (62620)..(62620): n is a, c, g, or t
  misc_feature (62622)..(62623): n is a, c, g, or t
  misc_feature (62627)..(62627): n is a, c, g, or t
  misc_feature (62638)..(62638): n is a, c, g, or t
  misc_feature (62640)..(62640): n is a, c, g, or t
  misc_feature (62643)..(62643): n is a, c, g, or t
  misc_feature (62650)..(62650): n is a, c, g, or t
  misc_feature (62658)..(62658): n is a, c, g, or t
  misc_feature (62676)..(62676): n is a, c, g, or t
  misc_feature (62679)..(62679): n is a, c, g, or t
  misc_feature (62681)..(62681): n is a, c, g, or t
  misc_feature (62685)..(62686): n is a, c, g, or t
  misc_feature (62693)..(62694): n is a, c, g, or t
  misc_feature (62696)..(62696): n is a, c, g, or t
  misc_feature (62700)..(62700): n is a, c, g, or t
  misc_feature (62703)..(62703): n is a, c, g, or t
  misc_feature (62724)..(62724): n is a, c, g, or t
aagcgttgcacaattcccccaacctccatacatacggcagctcttctagacacaggttttcccaggtcaaatgcggggaccccagccatatctcccaccctgagaaattttggagtttcagggagctcagaagctctgcagaggccaccctctctgaggggattcttcttagacctccatccagaggcaaatgttgacctgtccatgctgaaaccctcaggccttcctgggtcatcttctcccacccgctccttgatgacagggagcaggagcactaaagccacaccagaaatggattcaggactgacaggagccaccttgtcacctaagacatctacaggtgcaatcgtggtgacagaacatactctgccctttacttccccagataagaccttggccagtcctacatcttcggttgtgggaagaaccacccagtctttgggggtgatgtcctctgctctccctgagtcaacctctagaggaatgacacactccgagcaaagaaccagcccatcgctgagtccccaggtcaatggaactccctctaggaactaccctgctacaagcatggtttcaggattgagttccccaaggaccaggaccagttccacagaaggaaattttaccaaagaagcatctacatacacactcactgtagagaccacaagtggcccagtcactgagaagtacacagtccccactgagacctcaacaactgaaggtgacagcacagagaccccctgggacacaagatatattcctgtaaaaatcacatctccaatgaaaacatttgcagattcaactgcatccaaggaaaatgccccagtgtctatgactccagctgagaccacagttactgactcacatactccaggaaggacaaacccatcatttgggacactttattcttccttccttgacctatcacctaaagggaccccaaattccagaggtgaaacaagcctggaactgattctatcaaccactggatatcccttctcctctcctgaacctggctctgcaggacacagcagaataagtaccagtgcgcctttgtcatcatctgcttcagttctcgataataaaatatcagagaccagcatattctcaggccagagtctcacctcccctctgtctcctggggtgcccgaggccagagccagcacaatgcccaactcagctatccctttttccatgacactaagcaatgcagaaacaagtgccgaaagggtcagaagcacaatttcctctctggggactccatcaatatccacaaagcagacagcagagactatccttaccttccatgccttcgctgagaccatggatatacccagcacccacatagccaagactttggcttcagaatggttgggaagtccaggtacccttggtggcaccagcacttcagcgctgacaaccacatctccatctaccactttagtctcagaggagaccaacacccatcactccacgagtggaaaggaaacagaaggaactttgaatacatctatgactccacttgagacctctgctcctggagaagagtccgaaatgactgccaccttggtccccactctaggttttacaactcttgacagcaagatcagaagtccatctcaggtctcttcatcccacccaacaagagagctcagaaccacaggcagcacctctgggaggcagagttccagcacagctgcccacgggagctctgacatcctgagggcaaccacttccagcacctcaaaagcatcatcatggaccagtgaaagcacagctcagcaatttagtgaaccccagcacacacagtgggtggagacaagtcctagcatgaaaacagagagacccccagcatcaaccagtgtggcagcccctatcaccacttctgttccctcagtggtctctggcttcaccaccctgaagaccagctccacaaaagggatttggcttgaagaaacatctgcagacacactcatcggagaatccacagctggcccaaccacccatcagtttgctgttcccactgggatttcaatgacaggaggcagcagcaccaggggaagccagggcacaacccacctactcaccagagccacagcatcatctgagacatccgcagatttgactctggccacgaacggtgtcccagtctccgtgtctccagcagtgagcaagacggctgctggctcaagtcctccaggagggacaaagccatcatatacaatggtttcttctgtcatccctgagacatcatctctacagtcctcagctttcagggaaggaaccagcctgggactgactccattaaacactagacatcccttctcttcccctgaaccagactctgcaggacacaccaagataagcaccagcattcctctgttgtcatctgcttcagttcttgaggataaagtgtcagcgaccagcacattctcacaccacaaagccacctcatctattaccacagggactcctgaaatctcaacaaagacaaagcccagctcagccgttctttcctccatgaccctaagcaatgcagcaacaagtcctgaaagagtcagaaatgcaacttcccctctgactcatccatctccatcaggggaagagacagcagggagtgtcctcactctcagcacctctgctgagactacagactcacctaacatccacccaactgggacactgacttcagaatcgtcagagagtcctagcactctcagcctcccaagtgtctctggagtcaaaaccacattttcttcatctactccttccactcatctatttactagtggagaagaaacagaggaaacttcgaatccatctgtgtctcaacctgagacttctgtttccagagtaaggaccaccttggccagcacctctgtccctaccccagtattccccaccatggacacctggcctacacgttcagctcagttctcttcatcccacctagtgagtgagctcagagctacgagcagtacctcagttacaaactcaactggttcagctcttcctaaaatatctcacctcactgggacggcaacaatgtcacagaccaatagagacacgtttaatgactctgctgcaccccaaagcacaacttggccagagactagtcccagattcaagacagggttaccttcagcaacaaccactgtttcaacctctgccacttctctctctgctactgtaatggtctctaaattcacttctccagcaactagttccatggaagcaacttctatcagggaaccatcaacaaccatcctcacaacagagaccacgaatggcccaggctctatggctgtggcttctaccaacatcccaattggaaagggctacattactgaaggaagattggacacaagccatctgcccattggaaccacagcttcctctgagacatctatggattttaccatggccaaagaaagtgtctcaatgtcagtatctccatctcagtccatggatgctgctggctcaagcactccaggaaggacaagccaattcgttgacacattttctgatgatgtctatcatttaacatccagagaaattacaatacctagagatggaacaagctcagctctgactccacaaatgactgcaactcaccctccatctcctgatcctggctctgctagaagcacctggcttggcatcttgtcctcatctccttcttctcctactcccaaagtcacaatgagctccacattttcaactcagagagtcaccacaagcatgataatggacacagttgaaactagtcggtggaacatgcccaacttaccttccacgacttccctgacaccaagtaatattccaacaagtggtgccataggaaaaagcaccctggttcccttggacactccatctccagccacatcattggaggcatcagaagggggacttccaaccctcagcacctaccctgaatcaacaaacacacccagcatccacctcggagcacacgctagttcagaaagtccaagcaccatcaaacttaccatggcttcagtagtaaaacctggctcttacacacctctcaccttcccctcaatagagacccacattcatgtatcaacagccagaatggcttactcttctgggtcttcacctgagatgacagctcctggagagactaacactggtagtacctgggaccccaccacctacatcaccactacggatcctaaggatacaagttcagctcaggtctctacaccccactcagtgaggacactcagaaccacagaaaaccatccaaagacagagtccgccaccccagctgcttactctggaagtcctaaaatctcaagttcacccaatctcaccagtccggccacaaaagcatggaccatcacagacacaactgaacactccactcaattacattacacaaaattggcagaaaaatcatctggatttgagacacagtcagctccaggacctgtctctgtagtaatccctacctcccctaccattggaagcagcacattggaactaacttctgatgtcccaggggaacccctggtccttgctcccagtgagcagaccacaatcactctccccatggcaacatggctgagtaccagtttgacagaggaaatggcttcaacagaccttgatatttcaagtccaagttcacccatgagtacatttgctatttttccacctatgtccacaccttctcatgaactttcaaagtcagaggcagataccagtgccattagaaatacagattcaacaacgttggatcagcacctaggaatcaggagtttgggcagaactggggacttaacaactgttcctatcaccccactgacaaccacgtggaccagtgtgattgaacactcaacacaagcacaggacaccctttctgcaacgatgagtcctactcacgtgacacagtcactcaaagatcaaacatctataccagcctcagcatccccttcccatcttactgaagtctaccctgagctcgggacacaagggagaagctcctctgaggcaaccactttttggaaaccatctacagacacactgtccagagagattgagactggcccaacaaacattcaatccactccacccatggacaacacaacaacagggagcagtagtagtggagtcaccctgggcatagcccaccttcccataggaacatcctccccagctgagacatccacaaacatggcactggaaagaagaagttctacagccactgtctctatggctgggacaatgggactccttgttactagtgctccaggaagaagcatcagccagtcattaggaagagtttcctctgtcctttctgagtcaactactgaaggagtcacagattctagtaagggaagcagcccaaggctgaacacacagggaaatacagctctctcctcctctcttgaacccagctatgctgaaggaagccagatgagcacaagcatccctctaacctcatctcctacaactcctgatgtggaattcatagggggcagcacattttggaccaaggaggtcaccacagttatgacctcagacatctccaagtcttcagcaaggacagagtccagctcagctacccttatgtccacagctttgggaagcactgaaaatacaggaaaagaaaaactcagaactgcctctatggatcttccatctccaactccatcaatggaggtgacaccatggatttctctcactctcagtaatgcccccaataccacagattcacttgacctcagccatggggtgcacaccagctctgcagggactttggccactgacaggtcattgaatactggtgtcactagagcctccagattggaaaacggctctgatacctcttctaagtccctgtctatgggaaacagcactcacacttccatgactgacacagagaagagtgaagtgtcttcttcaatccatccccgacctgagacctcagctcctggagcagagaccactttgacttccactcctggaaacagggccataagcttaacattgcctttttcatccattccagtggaagaagtcatttctacaggcataacctcaggaccagacatcaactcagcacccatgacacattctcccatcaccccaccaacaattgtatggaccagtacaggcacaattgaacagtccactcaaccactacatgcagtttcttcagaaaaagtttctgtgcagacacagtcaactccatatgtcaactctgtggcagtgtctgcttcccctacccatgagaattcagtctcttctggaagcagcacatcctctccatattcctcagcctcacttgaatccttggattccacaatcagtaggaggaatgcaatcacttcctggctatgggacctcactacatctctccccactacaacttggccaagtactagtttatctgaggcactgtcctcaggccattctggggtttcaaacccaagttcaactacgactgaatttccactcttttcagctgcatccacatctgctgctaagcaaagaaatccagaaacagagacccatggtccccagaatacagccgcgagtactttgaacactgatgcatcctcggtcacaggtctttctgagactcctgtgggggcaagtatcagctctgaagtccctcttccaatggccataacttctagatcagatgtttctggccttacatctgagagtactgctaacccgagtttaggcacagcctcttcagcagggaccaaattaactaggacaatatccctgcccacttcagagtctttggtttcctttagaatgaacaaggatccatggacagtgtcaatccctttggggtcccatccaactactaatacagaaacaagcatcccagtaaacagcgcaggtccacctggcttgtccacagtagcatcagatgtaattgacacaccttcagatggggctgagagtattcccactgtctccttttccccctcccctgatactgaagtgacaactatctcacatttcccagaaaagacaactcattcatttagaaccatttcatctctcactcatgagttgacttcaagagtgacacctattcctggggattggatgagttcagctatgtctacaaagcccacaggagccagtccctccattacactgggagagagaaggacaatcacctctgctgctccaaccacttcccccatagttctcactgctagtttcacagagaccagcacagtttcactggataatgaaactacagtaaaaacctcagatatccttgacgcacggaaaacaaatgagctcccctcagatagcagttcttcttctgatctgatcaacacctccatagcttcttcaactatggatgtcactaaaacagcctccatcagtcccactagcatctcaggaatgacagcaagttcctccccatctctcttctcttcagatagaccccaggttcccacatctacaacagagacaaatacagccacctctccatctgtttccagtaacacctattctcttgatgggggctccaatgtgggtggcactccatccactttaccaccctttacaatcacccaccctgtcgagacaagctcggccctattagcctggtctagaccagtaagaactttcagcaccatggtcagcactgacactgcctccggagaaaatcctacctctagcaattctgtggtgacttctgttccagcaccaggtacatgggccagtgtaggcagtactactgacttacctgccatgggctttctcaagacaagtcctgcaggagaggcacactcacttctagcatcaactattgaaccagccactgccttcactccccatctctcagcagcagtggtcactggatccagtgctacatcagaagccagtcttctcactacgagtgaaagcaaagccattcattcttcaccacagaccccaactacacccacctctggagcaaactgggaaacttcagctactcctgagagccttttggtagtcactgagacttcagacacaacacttacctcaaagattttggtcacagataccatcttgttttcaactgtgtccacgccaccttctaaatttccaagtacggggactctgtctggagcttccttccctactttactcccggacactccagccatccctctcactgccactgagccaacaagttcattagctacatcctttgattccaccccactggtgactatagcttcggatagtcttggcacagtcccagagactaccctgaccatgtcagagacctcaaatggtgatgcactggttcttaagacagtaagtaacccagataggagcatccctggaatcactatccaaggagtaacagaaagtccactccatccttcttccacttccccctctaagattgttgctccacggaatacaacctatgaaggttcgatcacagtggcactttctactttgcctgcgggaactactggttcccttgtattcagtcagagttctgaaaactcagagacaacggctttggtagactcatcagctgggcttgagagggcatctgtgatgccactaaccacaggaagccagggtatggctagctctggaggaatcagaagtgggtccactcactcaactggaaccaaaacattttcttctctccctctgaccatgaacccaggtgaggttacagccatgtctgaaatcaccacgaacagactgacagctactcaatcaacagcacccaaagggatacctgtgaagcccaccagtgctgagtcaggcctcctaacacctgtctctgcctcctcaagcccatcaaaggcctttgcctcactgactacagctcccccatcaacttgggggatcccacagtctaccttgacatttgagttttctgaggtcccaagtttggatactaagtccgcttctttaccaactcctggacagtccctgaacaccattccagactcagatgcaagcacagcatcttcctcactgtccaagtctccagaaaaaaacccaagggcaaggatgatgacttccacaaaggccataagtgcaagctcatttcaatcaacaggttttactgaaacccctgagggatctgcctccccttctatggcagggcatgaacccagagtccccacttcaggaacaggggaccctagatatgcctcagagagcatgtcttatccagacccaagcaaggcatcatcagctatgacatcgacctctcttgcatcaaaactcacaactctcttcagcacaggtcaagcagcaaggtctggttctagttcctctcccataagcctatccactgagaaagaaacaagcttcctttcccccactgcatccacctccagaaagacttcactatttcttgggccttccatggcaaggcagcccaacatattggtgcatcttcagacttcagctctgacactttctccaacatccactctaaatatgtcccaggaggagcctcctgagttaacctcaagccagaccattgcagaagaagagggaacaacagctgaaacacagacgttaaccttcacaccatctgagaccccaacatccttgttacctgtctcttctcccacagaacccacagccagaagaaagagttctccagaaacatgggcaagctctatttcagttcctgccaagacctccttggttgaaacaactgatggaacgctagtgaccaccataaagatgtcaagccaggcagcacaaggaaattccacgtggcctgccccagcagaggagacggggaccagtccagcaggcacatccccaggaagcccagaagtgtctaccactctcaaaatcatgagctccaaggaacccagcatcagcccagagatcaggtccactgtgcgaaattctccttggaagactccagaaacaactgttcccatggagaccacagtggaaccagtcacccttcagtccacagccctaggaagtggcagcaccagcatctctcacctgcccacaggaaccacatcaccaaccaagtcaccaacagaaaatatgttggctacagaaagggtctccctctccccatccccacctgaggcttggaccaacctttattctggaactccaggagggaccaggcagtcactggccacaatgtcctctgtctccctagagtcaccaactgctagaagcatcacagggactggtcagcaaagcagtccagaactggtttcaaagacaactggaatggaattctctatgtggcatggctctactggagggaccacaggggacacacatgtctctctgagcacatcttccaatatccttgaagaccctgtaaccagcccaaactctgtgagctcattgacagataaatccaaacataaaaccgagacatgggtaagcaccacagccattccctccactgtcctgaataataagataatggcagctgaacaacagacaagtcgatctgtggatgaggcttattcatcaactagttcttggtcagatcagacatctgggagtgacatcacccttggtgcatctcctgatgtcacaaacacattatacatcacctccacagcacaaaccacctcactagtgtctctgccctctggagaccaaggcattacaagcctcaccaatccctcaggaggaaaaacaagctctgcgtcatctgtcacatctccttcaatagggcttgagactctgagggccaatgtaagtgcagtgaaaagtgacattgcccctactgctgggcatctatctcagacttcatctcctgcggaagtgagcatcctggacgtaaccacagctcctactccaggtatctccaccaccatcaccaccatgggaaccaactcaatctcaactaccacacccaacccagaagtgggtatgagtaccatggacagcaccccggccacagagaggcgcacaacttctacagaacacccttccacctggtcttccacagctgcatcagattcctggactgtcacagacatgacttcaaacttgaaagttgcaagatctcctggaacaatttccacaatgcatacaacttcattcttagcctcaagcactgaattagactccatgtctactccccatggccgtataactgtcattggaaccagcctggtcactccatcctctgatgcttcagctgtaaagacagagaccagtacaagtgaaagaacattgagtccttcagacacaactgcatctactcccatctcaactttttctcgtgtccagaggatgagcatctcagttcctgacattttaagtacaagttggactcccagtagtacagaagcagaagatgtgcctgtttcaatggtttctacagatcatgctagtacaaagactgacccaaatacgcccctgtccacttttctgtttgattctctgtccactcttgactgggacactgggagatctctgtcatcagccacagccactacctcagctcctcagggggccacaactccccaggaactcactttggaaaccatgatcagcccagctacctcacagttgcccttctctatagggcacattacaagtgcagtcacaccagctgcaatggcaaggagctctggagttactttttcaagaccagatcccacaagcaaaaaggcagagcagacttccactcagcttcccaccaccacttctgcacatccagggcaggtgcccagatcagcagcaacaactctggatgtgatcccacacacagcaaaaactccagatgcaacttttcagagacaagggcagacagctcttacaacagaggcaagagctacatctgactcctggaatgagaaagaaaaatcaaccccaagtgcaccttggatcactgagatgatgaattctgtctcagaagataccatcaaggaggttaccagctcctccagtgtattaaaggaccctgaatacgctggacataaacttggaatctgggacgacttcatccccaagtttggaaaagcagcccatatgagagagttgccccttctgagtccaccacaggacaaagaggcaattcacccttctacaaacacagtagagaccacaggctgggtcacaagttccgaacatgcttctcattccactatcccagcccactcagcgtcatccaaactcacatctccagtggttacaacctccaccagggaacaagcaatagtttctatgtcaacaaccacatggccagagtctacaagggctagaacagagcctaattccttcttgactattgaactgagggacgtcagcccttacatggacaccagctcaaccacacaaacaagtattatctcttccccaggttccactgcgatcaccaaggggcctagaacagaaattacctcctctaagagaatatccagctcattccttgcccagtctatgaggtcgtcagacagcccctcagaagccatcaccaggctgtctaactttcctgccatgacagaatctggaggaatgatccttgctatgcaaacaagtccacctggcgctacatcactaagtgcacctactttggatacatcagccacagcctcctggacagggactccactggctacgactcagagatttacatactcagagaagaccactctctttagcaaaggtcctgaggatacatcacagccaagccctccctctgtggaagaaaccagctcttcctcttccctggtacctatccatgctacaacctcgccttccaatattttgttgacatcacaagggcacagtccctcctctactccacctgtgacctcagttttcttgtctgagacctctggcctggggaagaccacagacatgtcgaggataagcttggaacctggcacaagtttacctcccaatttgagcagtacagcaggtgaggcgttatccacttatgaagcctccagagatacaaaggcaattcatcattctgcagacacagcagtgacgaatatggaggcaaccagttctgaatattctcctatcccaggccatacaaagccatccaaagccacatctccattggttacctcccacatcatgggggacatcacttcttccacatcagtatttggctcctccgagaccacagagattgagacagtgtcctctgtgaaccagggacttcaggagagaagcacatcccaggtggccagctctgctacagagacaagcactgtcattacccatgtgtctagtggtgatgctactactcatgtcaccaagacacaagccactttctctagcggaacatccatctcaagccctcatcagtttataacttctaccaacacatttacagatgtgagcaccaacccctccacctctctgataatgacagaatcttcaggagtgaccatcaccacccaaacaggtcctactggagctgcaacacagggtccatatctcttggacacatcaaccatgccttacttgacagagactccattagctgtgactccagattttatgcaatcagagaagaccactctcataagcaaaggtcccaaggatgtgacctggacaagccctccctctgtggcagaaaccagctatccctcttccctgacacctttcttggtcacaaccatacctcctgccacttccacgttacaagggcaacatacatcctctcctgtttctgcgacttcagttcttacctctggactggtgaagaccacagatatgttgaacacaagcatggaacctgtgaccaattcacctcaaaatttgaacaatccatcaaatgagatactggccactttggcagccaccacagatatagagactattcatccttccataaacaaagcagtgaccaatatggggactgccagttcagcacatgtactgcattccactctcccagtcagctcagaaccatctacagccacatctccaatggttcctgcctccagcatgggggacgctcttgcttctatatcaatacctggttctgagaccacagacattgagggagagccaacatcctccctgactgctggacgaaaagagaacagcaccctccaggagatgaactcaactacagagtcaaacatcatcctctccaatgtgtctgtgggggctattactgaagccacaaaaatggaagtcccctcttttgatgcaacattcataccaactcctgctcagtcaacaaagttcccagatattttctcagtagccagcagtagactttcaaactctcctcccatgacaatatctacccacatgaccaccacccagacagggtcttctggagctacatcaaagattccacttgccttagacacatcaaccttggaaacctcagcagggactccatcagtggtgactgaggggtttgcccactcaaaaataaccactgcaatgaacaatgatgtcaaggacgtgtcacagacaaaccctccctttcaggatgaagccagctctccctcttctcaagcacctgtccttgtcacaaccttaccttcttctgttgctttcacaccgcaatggcacagtacctcctctcctgtttctatgtcctcagttcttacttcttcactggtaaagaccgcaggcaaggtggatacaagcttagaaacagtgaccagttcacctcaaagtatgagcaacactttggatgacatatcggtcacttcagcagccaccacagatatagagacaacgcatccttccataaacacagtagttaccaatgtggggaccaccggttcagcatttgaatcacattctactgtctcagcttacccagagccatctaaagtcacatctccaaatgttaccacctccaccatggaagacaccacaatttcccgatcaatacctaaatcctctaagactacaagaactgagactgagacaacttcctccctgactcctaaactgagggagaccagcatctcccaggagatcacctcgtccacagagacaagcactgttccttacaaagagctcactggtgccactaccgaggtatccaggacagatgtcacttcctctagcagtacatccttccctggccctgatcagtccacagtgtcactagacatctccacagaaaccaacaccaggctgtctacctccccaataatgacagaatctgcagaaataaccatcaccacccaaacaggtcctcatggggctacatcacaggatacttttaccatggacccatcaaatacaaccccccaggcagggatccactcagctatgactcatggattttcacaattggatgtgaccactcttatgagcagaattccacaggatgtatcatggacaagtcctccctctgtggataaaaccagctccccctcttcctttctgtcctcacctgcaatgaccacaccttccctgatttcttctaccttaccagaggataagctctcctctcctatgacttcacttctcacctctggcctagtgaagattacagacatattacgtacacgcttggaacctgtgaccagctcacttccaaatttcagcagcacctcagataagatactggccacttctaaagacagtaaagacacaaaggaaatttttccttctataaacacagaagagaccaatgtgaaagccaacaactctggacatgaatcccattcccctgcactggctgactcagagacacccaaagccacaactcaaatggttatcaccaccactgtgggagatccagctccttccacatcaatgccagtgcatggttcctctgagactacaaacattaagagagagccaacatatttcttgactcctagactgagagagaccagtacctctcaggagtccagctttcccacggacacaagttttctactttccaaagtccccactggtactattactgaggtctccagtacaggggtcaactcttctagcaaaatttccaccccagaccatgataagtccacagtgccacctgacaccttcacaggagagatccccagggtcttcacctcctctattaagacaaaatctgcagaaatgacgatcaccacccaagcaagtcctcctgagtctgcatcgcacagtacccttcccttggacacatcaaccacactttcccagggagggactcattcaactgtgactcagggattcccatactcagaggtgaccactctcatgggcatgggtcctgggaatgtgtcatggatgacaactccccctgtggaagaaaccagctctgtgtcttccctgatgtcttcacctgccatgacatccccttctcctgtttcctccacatcaccacagagcatcccctcctctcctcttcctgtgactgcacttcctacttctgttctggtgacaaccacagatgtgttgggcacaacaagcccagagtctgtaaccagttcacctccaaatttgagcagcatcactcatgagagaccggccacttacaaagacactgcacacacagaagccgccatgcatcattccacaaacaccgcagtgaccaatgtagggacttccgggtctggacataaatcacaatcctctgtcctagctgactcagagacatcgaaagccacacctctgatgagtaccacctccaccctgggggacacaagtgtttccacatcaactcctaatatctctcagactaaccaaattcaaacagagccaacagcatccctgagccctagactgagggagagcagcacgtctgagaagaccagctcaacaacagagacaaatactgccttttcttatgtgcccacaggtgctattactcaggcctccagaacagaaatctcctctagcagaacatccatctcagaccttgatcggcccacaatagcacccgacatctccacaggaatgatcaccaggctcttcacctcccccatcatgacaaaatctgcagaaatgaccgtcaccactcaaacaactactcctggggctacatcacagggtatccttccttgggacacatcaaccacacttttccagggagggactcattcaaccgtgtctcagggattcccacactcagagataaccactcttcggagcagaacccctggagatgtgtcatggatgacaactccccctgtggaagaaaccagctctgggttttccctgatgtcaccttccatgacatccccttctcctgtttcctccacatcaccagagagcatcccctcctctcctctccctgtgactgcacttcttacttctgttctggtgacaaccaccaatgtattgggcacaacaagcccagagaccgtaacgagttcacctccaaatttaagcagccccacacaggagagactgaccacttacaaagacactgcgcacacagaagccatgcatgcttccatgcatacaaacactgcagtggccaacgtcgggacctccatttctggacatgaatcacaatcttctgtcccagctgattcacacacatccaaagccacatctccaatgggtatcaccttcgccatgggggatacaagtgtttctacatcaactcctgccttctttgagactagaattcagactgaatcaacatcctctttgattcctggattaagggacaccaggacgtctgaggagatcaacactgtgacagagaccagcactgtcctttcagaagtgcccactactactactactgaggtctccaggacagaagttatcacttccagcagaacaaccatctcagggcctgatcattccaaaatgtcaccctacatctccacagaaaccatcaccaggctctccacttttccttttgtaacaggatccacagaaatggccatcaccaaccaaacaggtcctatagggactatctcacaggctacccttaccctggacacatcaagcacagcttcctgggaagggactcactcacctgtgactcagagatttccacactcagaggagaccactactatgagcagaagtactaagggcgtgtcatggcaaagccctccctctgtggaagaaaccagttctccttcttccccagtgcctttacctgcaataacctcacattcatctctttattccgcagtatcaggaagtagccccacttctgctctccctgtgacttcccttctcacctctggcaggaggaagaccatagacatgttggacacacactcagaacttgtgaccagctccttaccaagtgcaagtagcttctcaggtgagatactcacttctgaagcctccacaaatacagagacaattcacttttcagagaacacagcagaaaccaatatggggaccaccaattctatgcataaactacattcctctgtctcaatccactcccagccatccggacacacacctccaaaggttactggatctatgatggaggacgctattgtttccacatcaacacctggttctcctgagactaaaaatgttgacagagactcaacatcccctctgactcctgaactgaaagaggacagcaccgccctggtgatgaactcaactacagagtcaaacactgttttctccagtgtgtccctggatgctgctactgaggtctccagggcagaagtcacctactatgatcctacattcatgccagcttctgctcagtcaacaaagtccccagacatttcacctgaagccagcagcagtcattctaactctcctcccttgacaatatctacacacaagaccatcgccacacaaacaggtccttctggggtgacatctcttggccaactgaccctggacacatcaaccatagccacctcagcaggaactccatcagccagaactcaggattttgtagattcagaaacaaccagtgtcatgaacaatgatctcaatgatgtgttgaagacaagccctttctctgcagaagaagccaactctctctcttctcaggcacctctccttgtgacaacctcaccttctcctgtaacttccacattgcaagagcacagtacctcctctcttgtttctgtgacctcagtacccacccctacactggcgaagatcacagacatggacacaaacttagaacctgtgactcgttcacctcaaaatttaaggaacaccttggccacttcagaagccaccacagatacacacacaatgcatccttctataaacacagcaatggccaatgtggggaccaccagttcaccaaatgaattctattttactgtctcacctgactcagacccatataaagccacatccgcagtagttatcacttccacctcgggggactcaatagtttccacatcaatgcctagatcctctgcgatgaaaaagattgagtctgagacaactttctccctgatatttagactgagggagactagcacctcccagaaaattggctcatcctcagacacaagcacggtctttgacaaagcattcactgctgctactactgaggtctccagaacagaactcacctcctctagcagaacatccatccaaggcactgaaaagcccacaatgtcaccggacacctccacaagatctgtcaccatgctttctacttttgctggcctgacaaaatccgaagaaaggaccattgccacccaaacaggtcctcatagggcgacatcacagggtacccttacctgggacacatcaatcacaacctcacaggcagggacccactcagctatgactcatggattttcacaattagatttgtccactcttacgagtagagttcctgagtacatatcagggacaagcccaccctctgtggaaaaaaccagctcttcctcttcccttctgtctttaccagcaataacctcaccgtcccctgtacctactacattaccagaaagtaggccgtcttctcctgttcatctgacttcactccccacctctggcctagtgaagaccacagatatgctggcatctgtggccagtttacctccaaacttgggcagcacctcacataagataccgactacttcagaagacattaaagatacagagaaaatgtatccttccacaaacatagcagtaaccaatgtggggaccaccacttctgaaaaggaatcttattcgtctgtcccagcctactcagaaccacccaaagtcacctctccaatggttacctctttcaacataagggacaccattgtttccacatccatgcctggctcctctgagattacaaggattgagatggagtcaacattctccgtggctcatgggctgaagggaaccagcacctcccaggaccccatcgtatccacagagaaaagtgctgtccttcacaagttgaccactggtgctactgagacctctaggacagaagttgcctcttctagaagaacatccattccaggccctgatcattccacagagtcaccagacatctccactgaagtgatccccagcctgcctatctcccttggcattacagaatcttcaaatatgaccatcatcactcgaacaggtcctcctcttggctctacatcacagggcacatttaccttggacacaccaactacatcctccagggcaggaacacactcgatggcgactcaggaatttccacactcagaaatgaccactgtcatgaacaaggaccctgagattctatcatggacaatccctccttctatagagaaaaccagcttctcctcttccctgatgccttcaccagccatgacttcacctcctgtttcctcaacattaccaaagaccattcacaccactccttctcctatgacctcactgctcacccctagcctagtgatgaccacagacacattgggcacaagcccagaacctacaaccagttcacctccaaatttgagcagtacctcacatgtgatactgacaacagatgaagacaccacagctatagaagccatgcatccttccacaagcacagcagcgactaatgtggaaaccacctgttctggacatgggtcacaatcctctgtcctaactgactcagaaaaaaccaaggccacagctccaatggataccacctccaccatggggcatacaactgtttccacatcaatgtctgtttcctctgagactacaaaaattaagagagagtcaacatattccttgactcctggactgagagagaccagcatttcccaaaatgccagcttttccactgacacaagtattgttctttcagaagtccccactggtactactgctgaggtctccaggacagaagtcacctcctctggtagaacatccatccctggcccttctcagtccacagttttgccagaaatatccacaagaacaatgacaaggctctttgcctcgcccaccatgacagaatcagcagaaatgaccatccccactcaaacaggtccttctgggtctacctcacaggatacccttaccttggacacatccaccacaaagtcccaggcaaagactcattcaactttgactcagagatttccacactcagagatgaccactctcatgagcagaggtcctggagatatgtcatggcaaagctctccctctctggaaaatcccagctctctcccttccctgctgtctttacctgccacaacctcacctcctcccatttcctccacattaccagtgactatctcctcctctcctcttcctgtgacttcacttctcacctctagcccggtaacgaccacagacatgttacacacaagcccagaacttgtaaccagttcacctccaaagctgagccacacttcagatgagagactgaccactggcaaggacaccacaaatacagaagctgtgcatccttccacaaacacagcagcgtccaatgtggagattcccagctttggacatgaatccccttcctctgccttagctgactcagagacatccaaagccacatcaccaatgtttattacctccacccaggaggatacaactgttgccatatcaacccctcacttcttggagactagcagaattcagaaagagtcaatttcctccctgagccctaaattgagggagacaggcagttctgtggagacaagctcagccatagagacaagtgctgtcctttctgaagtgtccattggtgctactactgagatctccaggacagaagtcacctcctctagcagaacatccatctctggttctgctgagtccacaatgttgccagaaatatccaccacaagaaaaatcattaagttccctacttcccccatcctggcagaatcatcagaaatgaccatcaagacccaaacaagtcctcctgggtctacatcagagagtacctttacattagacacatcaaccactccctccttggtaataacccattcgactatgactcagagattgccacactcagagataaccactcttgtgagtagaggtgctggggatgtgccacggcccagctctctccctgtggaagaaacaagccctccatcttcccagctgtctttatctgccatgatctcaccttctcctgtttcttccacattaccagcaagtagccactcctcttctgcttctgtgacttcacctctcacaccaggccaagtgaagactactgaggtgttggacgcaagtgcagaacctgaaaccagttcacctccaagtttgagcagcacctcagttgaaatactggccacctctgaagtcaccacagatacggagaaaattcatcctttcccaaacacggcagtaaccaaagttggaacttccagttctggacatgaatccccttcctctgtcctacctgactcagagacaaccaaagccacatcggcaatgggtaccatctccattatgggggatacaagtgtttctacattaactcctgccttatctaacactaggaaaattcagtcagagccagcttcctcactgaccaccagattgagggagaccagcacctctgaagagaccagcttagccacagaagcaaacactgttctttctaaagtgtccactggtgctactactgaggtctccaggacagaagccatctcctttagcagaacatccatgtcaggccctgagcagtccacaatgtcacaagacatctccataggaaccatccccaggatttctgcctcctctgtcctgacagaatctgcaaaaatgaccatcacaacccaaacaggtccttcggagtctacactagaaagtacccttaatttgaacacagcaaccacaccctcttgggtggaaacccactctatagtaattcagggatttccacacccagagatgaccacttccatgggcagaggtcctggaggtgtgtcatggcctagccctccctttgtgaaagaaaccagccctccatcctccccgctgtctttacctgccgtgacctcacctcatcctgtttccaccacattcctagcacatatccccccctctccccttcctgtgacttcacttctcacctctggcccggcgacaaccacagatatcttgggtacaagcacagaacctggaaccagttcatcttcaagtttgagcaccacctcccatgagagactgaccacttacaaagacactgcacatacagaagccgtgcatccttccacaaacacaggagggaccaatgtggcaaccaccagctctggatataaatcacagtcctctgtcctagctgactcatctccaatgtgtaccacctccaccatgggggatacaagtgttctcacatcaactcctgccttccttgagactaggaggattcagacagagctagcttcctccctgacccctggattgagggagtccagtggctctgaagggaccagctcaggcaccaagatgagcactgtcctctctaaagtgcccactggtgctactactgagatctccaaggaagacgtcacctccatcccaggtcccgctcaatccacaatatcaccagacatctccacaagaaccgtcagctggttctctacatcccctgtcatgacagaatcagcagaaataaccatgaacacccatacaagtcctttaggggccacaacacaaggcaccagtactttggccacgtcaagcacaacctctttgacaatgacacactcaactatatctcaaggattttcacactcacagatgagcactcttatgaggaggggtcctgaggatgtatcatggatgagccctccccttctggaaaaaactagaccttccttttctctgatgtcttcaccagccacaacttcaccttctcctgtttcctccacattaccagagagcatctcttcctctcctcttcctgtgacttcactcctcacgtctggcttggcaaaaactacagatatgttgcacaaaagctcagaacctgtaaccaactcacctgcaaatttgagcagcacctcagttgaaatactggccacctctgaagtcaccacagatacagagaaaactcatccttcttcaaacagaacagtgaccgatgtggggacctccagttctggacatgaatccacttcctttgtcctagctgactcacagacatccaaagtcacatctccaatggttattacctccaccatggaggatacgagtgtctccacatcaactcctggcttttttgagactagcagaattcagacagaaccaacatcctccctgacccttggactgagaaagaccagcagctctgaggggaccagcttagccacagagatgagcactgtcctttctggagtgcccactggtgccactgctgaagtctccaggacagaagtcacctcctctagcagaacatccatctcaggctttgctcagctcacagtgtcaccagagacttccacagaaaccatcaccagactccctacctccagcataatgacagaatcagcagaaatgatgatcaagacacaaacagatcctcctgggtctacaccagagagtactcatactgtggacatatcaacaacacccaactgggtagaaacccactcgactgtgactcagagattttcacactcagagatgaccactcttgtgagcagaagccctggtgatatgttatggcctagtcaatcctctgtggaagaaaccagctctgcctcttccctgctgtctctgcctgccacgacctcaccttctcctgtttcctctacattagtagaggatttcccttccgcttctcttcctgtgacttctcttctcacccctggcctggtgataaccacagacaggatgggcataagcagagaacctggaaccagttccacttcaaatttgagcagcacctcccatgagagactgaccactttggaagacactgtagatacagaagacatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccgcattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcatctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagcgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccagtgaagtgatcaccaggctctctacctcccccatcaaggcagaatctacagaaatgaccattaccacccaaacaggttctcctggggctacatcaaggggtacccttaccttggacacttcaacaacttttatgtcagggacccactcaactgcatctcaaggattttcacactcacagatgaccgctcttatgagtagaactcctggagatgtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccaccactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacagtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccacttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgtcctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggacgataccactgttttcacatcaaatcctgccttctctgagactaggaggattccgacagagccaacattctcattgactcctggattcagggagactagcacctctgaagagaccacctcaatcacagaaacaagtgcagtcctttatggagtgcccactagtgctactactgaagtctccatgacagaaatcatgtcctctaatagaacacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctccctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggatttaggaagacaaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcaacacccattttggataccagaatgacagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctttgaagaccaccaccacagctttgaagaccacttccagagccaccttgaccaccagtgtctatactcccactttgggaacactgactcccctcaatgcatcaaggcaaatggccagcacaatcctcacagaaatgatgatcacaaccccatatgttttccctgatgttccagaaacgacatcctcattggctaccagcctgggagcagaaaccagcacagctcttcccaggacaaccccatctgttctcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtcctggggcagaaaccagttcagctattccaattatgactgtctcacctggtgcagaagatctggtgacctcacaggtcactagttctgggacagacagaaatatgactattccaactttgactctttctcctggtgaaccaaagacgatagcctcattagtcacccatcctgaagcacagacaagttcggccattccaacttcaactatctcgcctgctgtatcacggttggtgacctcaatggtcaccagtttggcggcaaagacaagtacaactaatcgagctctgacaaactcccctggtgaaccagctacaacagtttcattggtcacgcatcctgcacagaccagcccaacagttccctggacaacttccatttttttccatagtaaatcagacaccacaccttcaatgaccaccagtcatggggcagaatccagttcagctgttccaactccaactgtttcaactgaggtaccaggagtagtgacccctttggtcaccagttctagggcagtgatcagtacaactattccaattctgactctttctcctggtgaaccagagaccacaccttcaatggccaccagtcatggggaagaagccagttctgctattccaactccaactgtttcacctggggtaccaggagtggtgacctctctggtcactagttctagggcagtgactagtacaactattccaattctgactttttctcttggtgaaccagagaccacaccttcaatggccaccagtcatgggacagaagctggctcagctgttccaactgttttacctgaggtaccaggaatggtgacctctctggttgctagttctagggcagtaaccagtacaactcttccaactctgactctttctcctggtgaaccagagaccacaccttcaatggccaccagtcatggggcagaagccagctcaactgttccaactgtttcacctgaggtaccaggagtggtgacctctctggtcactagttctagtggagtaaacagtacaagtattccaactctgattctttctcctggtgaactagaaaccacaccttcaatggccaccagtcatggggcagaagccagctcagctgttccaactccaactgtttcacctggggtatcaggagtggtgacccctctggtcactagttccagggcagtgaccagtacaactattccaattctaactctttcttctagtgagccagagaccacaccttcaatggccaccagtcatggggtagaagccagctcagctgttctaactgtttcacctgaggtaccaggaatggtgacctctctggtcactagttctagagcagtaaccagtacaactattccaactctgactatttcttctgatgaaccagagaccacaacttcattggtcacccattctgaggcaaagatgatttcagccattccaactttagctgtctcccctactgtacaagggctggtgacttcactggtcactagttctgggtcagagaccagtgcgttttcaaatctaactgttgcctcaagtcaaccagagaccatagactcatgggtcgctcatcctgggacagaagcaagttctgttgttccaactttgactgtctccactggtgagccgtttacaaatatctcattggtcacccatcctgcagagagtagctcaactcttcccaggacaacctcaaggttttcccacagtgaattagacactatgccttctacagtcaccagtcctgaggcagaatccagctcagccatttcaactactatttcacctggtataccaggtgtgctgacatcactggtcactagctctgggagagacatcagtgcaacttttccaacagtgcctgagtccccacatgaatcagaggcaacagcctcatgggttactcatcctgcagtcaccagcacaacagttcccaggacaacccctaattattctcatagtgaaccagacaccacaccatcaatagccaccagtcctggggcagaagccacttcagattttccaacaataactgtctcacctgatgtaccagatatggtaacctcacaggtcactagttctgggacagacaccagtataactattccaactctgactctttcttctggtgagccagagaccacaacctcatttatcacctattctgagacacacacaagttcagccattccaactctccctgtctcccctggtgcatcaaagatgctgacctcactggtcatcagttctgggacagacagcactacaactttcccaacactgacggagaccccatatgaaccagagacaacagccatacagctcattcatcctgcagagaccaacacaatggttcccaagacaactcccaagttttcccatagtaagtcagacaccacactcccagtagccatcaccagtcctgggccagaagccagttcagctgtttcaacgacaactatctcacctgatatgtcagatctggtgacctcactggtccctagttctgggacagacaccagtacaaccttcccaacattgagtgagaccccatatgaaccagagactacagtcacgtggctcactcatcctgcagaaaccagcacaacggtttctgggacaattcccaacttttcccataggggatcagacactgcaccctcaatggtcaccagtcctggagtagacacgaggtcaggtgttccaactacaaccatcccacccagtataccaggggtagtgacctcacaggtcactagttctgcaacagacactagtacagctattccaactttgactccttctcctggtgaaccagagaccacagcctcatcagctacccatcctgggacacagactggcttcactgttccaattcggactgttccctctagtgagccagatacaatggcttcctgggtcactcatcctccacagaccagcacacctgtttccagaacaacctccagtttttcccatagtagtccagatgccacacctgtaatggccaccagtcctaggacagaagccagttcagctgtactgacaacaatctcacctggtgcaccagagatggtgacttcacagatcactagttctggggcagcaaccagtacaactgttccaactttgactcattctcctggtatgccagagaccacagccttattgagcacccatcccagaacagggacaagtaaaacatttcctgcttcaactgtgtttcctcaagtatcagagaccacagcctcactcaccattagacctggtgcagagactagcacagctctcccaactcagacaacatcctctctcttcaccctacttgtaactggaaccagcagagttgatctaagtccaactgcttcacctggtgtttctgcaaaaacagccccactttccacccatccagggacagagaccagcacaatgattccaacttcaactctttcccttggtttactagagactacaggcttactggccaccagctcttcagcagagaccagcacgagtactctaactctgactgtttcccctgctgtctctgggctttccagtgcctctataacaactgataagccccaaactgtgacctcctggaacacagaaacctcaccatctgtaacttcagttggacccccagaattttccaggactgtcacaggcaccactatgaccttgataccatcagagatgccaacaccacctaaaaccagtcatggagaaggagtgagtccaaccactatcttgagaactacaatggttgaagccactaatttagctaccacaggttccagtcccactgtggccaagacaacaaccaccttcaatacactggctggaagcctctttactcctctgaccacacctgggatgtccaccttggcctctgagagtgtgacctcaagaacaagttataaccatcggtcctggatctccaccaccagcagttataaccgtcggtactggacccctgccaccagcactccagtgacttctacattctccccagggatttccacatcctccatccccagctccacagcagccacagtcccattcatggtgccattcaccctcaacttcaccatcaccaacctgcagtacgaggaggacatgcggcaccctggttccaggaagttcaacgccacagagagagaactgcagggtctgctcaaacccttgttcaggaatagcagtctggaatacctctattcaggctgcagactagcctcactcaggccagagaaggatagctcagccatggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacggctgctggccctctcctgatgccgttcaccctcaacttcaccatcaccaacctgcagtacgaggaggacatgcgtcgcactggctccaggaagttcaacaccatggagagtgtcctgcagggtctgctcaagcccttgttcaagaacaccagtgttggccctctgtactctggctgcagattgaccttgctcaggcccgagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtttcacccatcagagctctgtgtccaccaccagcactcctgggacctccacagtggatctcagaacctcagggactccatcctccctctccagccccacaattatggctgctggccctctcctggtaccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtctgagaaggatggagcagccactggagtggatgccatctgcatccatcatcttgaccccaaaagccctggactcaacagagagcggctgtactgggagctgagccaactgaccaatggcatcaaagagctgggcccctacaccctggacaggaacagtctctatgtcaatggtttcacccatcggacctctgtgcccaccaccagcactcctgggacctccacagtggaccttggaacctcagggactccattctccctcccaagccccgcaactgctggccctctcctggtgctgttcaccctcaacttcaccatcaccaacctgaagtatgaggaggacatgcatcgccctggctccaggaagttcaacaccactgagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggactggacagagagcagctatactgggagctgagccagctgaccaatggcatcaaagagctgggcccctacaccctggacaggaacagtctctatgtcaatggtttcacccattggatccctgtgcccaccagcagcactcctgggacctccacagtggaccttgggtcagggactccatcctccctccccagccccacagctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctacatcngctggccctctcctggtnccnttcaccctcaacttcaccatcaccaacctgcagtacgaggaggacatgcggcacccnggntccaggaagttcaacaccacngagagggtnctgcagggtctgctnaagcccctnttcaagagcaccagtgttggccctctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctacatctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcaacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccacaacagctgttcctctcctggtgccgttcaccctcaactttaccatcaccaatctgcagtatggggaggacatgcgtcaccctggctccaggaagttcaacaccacagagagggtcctgcagggtctgcttggtcccttgttcaagaactccagtgtcggccctctgtactctggctgcagactgatctctctcaggtctgagaaggatggggcagccactggagtggatgccatctgcacccaccaccttaaccctcaaagccctggactggacagggagcagctgtactggcagctgagccagatgaccaatggcatcaaagagctgggcccctacaccctggaccggaacagtctctacgtcaatggtttcacccatcggagctctgggctcaccaccagcactccttggacttccacagttgaccttggaacctcagggactccatcccccgtccccagccccacaactgctggccctctcctggtgccattcaccctcaacttcaccatcaccaacctgcagtatgaggaggacatgcatcgccctggatctaggaagttcaacaccacagagagggtcctgcagggtctgcttagtcccattttcaagaactccagtgttggccctctgtactctggctgcagactgacctctctcaggcccgagaaggatggggcagcaactggaatggatgctgtctgcctctaccaccctaatcccaaaagacctggactggacagagagcagctgtactgggagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacacagagcctggccctctcctgataccattcactttcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgacctctctcaggcccgagaaggatggggcagcaactggaatggatgctgtctgcctctaccaccctaatcccaaaagacctgggctggacagagagcagctgtactgggagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacacagagcctggccctctcctgataccattcactttcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgaccttgctcagacctgagaagcatgaggcagccactggagtggacaccatctgtacccaccgcgttgatcccatcggacctggactggacagggagcggctatactgggagctgagccagctgaccaacagcattaccgaactgggaccctacaccctggacagggacagtctctatgtcaatggcttcaaccctcggagctctgtgccaaccaccagcactcctgggacctccacagtgcacctggcaacctctgggactccatcctccctgcctggccacacagcccctgtccctctcttgataccattcaccctcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgaccttgctcagacctgagaagcatgaggcagccactggagtggacaccatctgtacccaccgcgttgatcccatcggacctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacatctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcgacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccacaacagctgttcctctcctggtgccgttcaccctcaactttaccatcaccaatctgcagtatggggaggacatgcgtcaccctggctccaggaagttcaacaccacagagagggtcctgcagggtctgcttggtcccttgttcaagaactccagtgtcggccctctgtactctggctgcagactgatctctctcaggtctgagaaggatggggcagccactggagtggatgccatctgcacccaccaccttaaccctcaaagccctggactggacagggagcagctgtactggcagctgagccagatgaccaatggcatcaaagagctgggcccctacaccctggaccggaacagtctctacgtcaatggtttcacccatcggagctctgggctcaccaccagcactccttggacttccacagttgaccttggaacctcagggactccatcccccgtccccagccccacaactgctggccctctcctggtgccattcaccctaaacttcaccatcaccaacctgcagtatgaggaggacatgcatcgccctggatctaggaagttcaacgccacagagagggtcctgcagggtctgcttagtcccatattcaagaactccagtgttggccctctgtactctggctgcagactgacctctctcaggcccgagaaggatggggcagcaactggaatggatgctgtctgcctctaccaccctaatcccaaaagacctggactggacagagagcagctgtactgggagctaagccagctgacccacaacatcactgagctgggcccctacagcctggacagggacagtctctatgtcaatggtttcacccatcagagctctatgacgaccaccagaactcctgatacctccacaatgcacctggcaacctcgagaactccagcctccctgtctggacctacgaccgccagccctctcctggtgctattcacaatcaactgcaccatcaccaacctgcagtacgaggaggacatgcgtcgcactggctccaggaagttcaacaccatggagagtgtcctgcagggtctgctcaagcccttgttcaagaacaccagtgttggccctctgtactctggctgcagattgaccttgctcaggcccaagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtttcacccatcagagctctgtgtccaccaccagcactcctgggacctccacagtggatctcagaacctcagggactccatcctccctctccagccccacaattatgncnnctgnccctctcctgntnccnttcaccntcaacttnaccatcaccaacctgcantangnggannacatgcnncncccnggntccaggaagttcaacaccacngagagggtcctacagggtctgctcaggcccttgttcaagaacaccagtgtcagctctctgtactctggttgcagactgaccttgctcaggcctgagaaggatggggcagccaccagagtggatgctgcctgcacctaccgccctgatcccaaaagccctggactggacagagagcaactatactgggagctgagccagctaacccacagcatcactgagctgggaccctacaccctggacagggtcagtctctatgtcaatggcttcaaccctcggagctctgtgccaaccaccagcactcctgggacctccacagtgcacctggcaacctctgggactccatcctccctgcctggccacacancnnctgnccctctcctgntnccnttcaccntcaacttnaccatcaccaacctgcantangnggannacatgcnncncccnggntccaggaagttcaacaccacngagagggttctgcagggtctgctcaaacccttgttcaggaatagcagtctggaatacctctattcaggctgcagactagcctcactcaggccagagaaggatagctcagccatggcagtggatgccatctgcacacatcgccctgaccctgaagacctcggactggacagagagcgactgtactgggagctgagcaatctgacaaatggcatccaggagctgggcccctacaccctggaccggaacagtctctacgtcaatggtttcacccatcggagctctgggctcaccaccagcactccttggacttccacagttgaccttggaacctcagggactccatcccccgtccccagccccacaactgctggccctctcctggtgccattcaccctcaacttcaccatcaccaacctgcagtatgaggaggacatgcatcgccctggttccaggaggttcaacaccacggagagggttctgcagggtctgctcacgcccttgttcaagaacaccagtgttggccctctgtactctggctgcagactgaccttgctcagacctgagaagcaagaggcagccactggagtggacaccatctgtacccaccgcgttgatcccatcggacctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacacagcccctgtccctctcttgataccattcaccctcaactttaccatcaccgacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccatcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcagcaccacggagagagtcctgcagggtctgctcaagcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccacgctcaggcccaagaaggatggggcagccaccaaagtggatgccatctgcacctaccgccctgatcccaaaagccctggactggacagagagcagctatactgggagctgagccagctaacccacagcatcactgagctgggcccctacacccaggacagggacagtctctatgtcaatggcttcacccatcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaacccaggactggacagagagcagctatactgggagctgagcaaactgacccgtggcatcatcgagctgggcccctacctcctggacagaggcagtctctatgtcaatggtttcacccatcggacctctgtgcccaccaccagcactcctgggacctccacagtggaccttggaacctcagggactccattctccctcccaagccccgcancnnctgnccctctcctgntnccnttcaccntcaacttnaccatcaccaacctgcantangnggannacatgcnncncccnggntccaggaagttcaacaccacngagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggagtggacagggagcaactatactgggagctgagccagctgaccaatggcattaaagaactgggcccctacaccctggacaggaacagtctctatgtcaatgggttcacccattggatccctgtgcccaccagcagcactcctgggacctccacagtggaccttgggtcagggactccatcctccctccccagccccacaactgctggccctctcctggtgccgttcaccctcaacttcaccatcaccaacctgaagtacgaggaggacatgcattgccctggctccaggaagttcaacaccacagagagagtcctgcagagtctgcttggtcccatgttcaagaacaccagtgttggccctctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccattggatccctgtgcccaccagcagcactcctgggacctccacagtggaccttgggtcagggactccatcctccctccccagccccacaactgctggccctctcctggtgccgttcaccctcaacttcaccatcaccaacctgaagtacgaggaggacatgcattgccctggctccaggaagttcaacaccacagagagagtcctgcagagtctgcttggtcccatgttcaagaacaccagtgttggccctctgtactctggctgcagactgacctcgctcaggtccgagaaggatggagcagccactggagtggatgccatctgcacccaccgtgttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtgnacntnggnacctcngggactccatcctccntccccngccncacatctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcaaccactggaatggatgccatctgcacccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagagggttctgcagggtctgctcaaacccttgttcaggaatagcagtctggaatacctctattcaggctgcagactagcctcactcaggccagagaaggatagctcagccatggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacgactgctggccctctcctgataccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtctgagaaggatggagcagccactggagtggatgccatctgcatccatcatcttgaccccaaaagccctggactcaacagagagcggctgtactgggagctgagccaactgaccaatggcatcaaagagctgggcccctacaccctggacaggaacagtctctatgtcaatggtttcacccatcggacctctgtgcccaccaccagcactcctgggacctccacagtggaccttggaacctcagggactccattctccctcccaagccccgcaactgctggccctctcctggtgctgttcaccctcaacttcaccatcaccaacctgaagtatgaggaggacatgcatcgccctggctccaggaagttcaacaccactgagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacacccaggacagggacagtctctatgtcaatggcttcacccatcggagctctgtgccaaccaccagtattcctgggacctctgcagtgcacctggaaaccactgggactccatcctccttccccggccacacagagcctggccctctcctgataccattcactttcaactttaccatcaccaacctgcgttatgaggaaaacatgcaacaccctggttccaggaagttcaacaccacggagagggttctgcagggtctgctcacgcccttgttcaagaacaccagtgttggccctctgtactctggctgcagactgaccttgctcagacctgagaagcaggaggcagccactggagtggacaccatctgtacccaccgcgttgatcccatcggacctggactggacagagagcggctatactgggagctgagccagctgaccaacagcatcacagagctgggaccctacaccctggatagggacagtctctatgtcgatggcttcaacccttggagctctgtgccaaccaccagcactcctgggacctccacagtgcacctggcaacctctgggactccatcccccctgcctggccacacagcccctgtccctctcttgataccattcaccctcaactttaccatcaccgacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacacaactgctggccctctcctggtgccgttcaccctcaacttcaccatcaccaacctgaagtacgaggaggacatgcattgccctggctccaggaagttcaacaccacagagagagtcctgcagagtctgcatggtcccatgttcaagaacaccagtgttggccctctgtactctggctgcagactgaccttgctcaggtccgagaaggatggagcagccactggagtggatgccatctgcacccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaacagcatcacagagctgggaccctacaccctggatagggacagtctctatgtcaatggtttcacccatcgaagctctatgcccaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggttttcaccctcggagctctgtgccaaccaccagcactcctgggacctccacagtgcacctggcaacctctgggactccatcctccctgcctggccacacagcccctgtccctctcttgataccattcaccctcaactttaccatcaccaacctgcattatgaagaaaacatgcaacaccctggttccaggaagttcaacaccacggagcgggtcctgcagggtctgcttggtcccatgttcaagaacacaagtgtcggccttctgtactctggctgcagactgaccttgctcaggcctgagaagaatggggcagccactggaatggatgccatctgcagccaccgtcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcagaactctgtgcccaccaccagtactcctgggacctccacagtgtactgggcaaccactgggactccatcctccttccccggccacacagagcctggccctctcctgataccattcactttcaactttaccatcaccaacctgcattatgaggaaaacatgcaacaccctggttccaggaagttcaacaccacggagagggttctgcagggtctgctcacgcccttgttcaagaacaccagtgttggccctctgtactctggctgcagactgaccttgctcagacctgagaagcaggaggcagccactggagtggacaccatctgtacccaccgcgttgatcccatcggacctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcggagctctgtgccaaccaccagcagtcctgggacctccacagtgcacctggcaacctctgggactccatcctccctgcctggccacacagcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagtgttggccctctgtactctggctgcagactgaccttgctcagacctgagaaacatggggcagccactggagtggacgccatctgcaccctccgccttgatcccactggtcctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcggacctctgtgcccaccaccagcactcctgggacctccacagtgcacctggcaacctctgggactccatcctccctgcctggccacacagcccctgtccctctcttgataccattcaccctcaactttaccatcaccaacctgcagtatgaggaggacatgcatcgccctggatctaggaagttcaacaccacagagagggtcctgcagggtctgcttagtcccattttcaagaactccagtgttggccctctgtactctggctgcagactgacctctctcaggcccgagaaggatggggcagcaactggaatggatgctgtctgcctctaccaccctaatcccaaaagacctgggctggacagagagcagctgtactgcgagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccattggagctctgggctcaccaccagcactccttggacttccacagttgaccttggaacctcagggactccatcccccgtccccagccccacaactgctggccctctcctggtgccattcaccctaaacttcaccatcaccaacctgcagtatgaggaggacatgcatcgccctggatctaggaagttcaacgccacagagagggtcctgcagggtctgcttagtcccatattcaagaacaccagtgttggccctctgtactctggctgcagactgaccttgctcagacctgagaagcaggaggcagccactggagtggacaccatctgtacccaccgcgttgatcccatcggacctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcggagctttgggctcaccaccagcactccttggacttccacagttgaccttggaacctcagggactccatcccccgtccccagccccacaactgctggccctctcctggtgccattcaccctaaacttcaccatcaccaacctgcagtatgaggaggacatgcatcgccctggctccaggaagttcaacaccacggagagggtccttcagggtctgcttacgcccttgttcaggaacaccagtgtcagctctctgtactctggttgcagactgaccttgctcaggcctgagaaggatggggcagccaccagagtggatgctgtctgcacccatcgtcctgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccattggatccctgtgcccaccagcagcactcctgggacctccacagtggaccttgggtcagggactccatcctccctccccagccccacaactgctggccctctcctggtaccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtccgagaaggatggagcagccactggagtggatgccatctgcatccatcatcttgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacancnnctgnccctctcctgntnccnttcaccntcaacttnaccatcaccaacctgcantangnggannacatgcnncncccnggntccaggaagttcaacaccacngagngngtnctgcagggtctgctnnnncccntnttcaagaacnccagtgtnggccntctgtactctggctgcagactgacctnnctcaggncngagaagnatggngcagccactggantggatgccatctgcanccaccnncntnancccaaaagncctggactgnacagngagcngctntactgggagctnagccanctgaccaannncatcnnngagctgggnccctacaccctggacaggnacagtctctatgtcaatggtttcacccatcagacctttgcgcccaacaccagcactcctgggacctccacagtggaccttgggacctcagggactccatcctccctccccagccctacatctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccaccagagtggatgctgtctgcacccatcgtcctgaccccaaaagccctggactgnacagngagcngctntactgggagctnagccanctgaccaannncatcnnngagctgggnccctacaccctggacaggnacagtctctatgtcaatggtttcacccatcnganctctgngcccaccaccagcactcctgggacctccacagtgnacntnggnacctcngggactccatcctccntccccngccncacagcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccagcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggtggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactggacagagagcagctatactgggagctgagcaaactgacccgtggcatcatcgagctgggcccctacctcctggacagaggcagtctctatgtcaatggtttcacccatcggaactttgtgcccatcaccagcactcctgggacctccacagtacacctaggaacctctgaaactccatcctccctacctagacccatagtgcctggccctctcctggtgccattcaccctcaacttcaccatcaccaacttgcagtatgaggaggccatgcgacaccctggctccaggaagttcaataccacggagagggtcctacagggtctgctcaggcccttgttcaagaataccagtatcggccctctgtactccagctgcagactgaccttgctcaggccagagaaggacaaggcagccaccagagtggatgccatctgtacccaccaccctgaccctcaaagccctggactgaacagagagcagctgtactgggagctgagccagctgacccacggcatcactgagctgggcccctacaccctggacagggacagtctctatgtcgatggtttcactcattggagccccataccgaccaccagcactcctgggacctccatagtgaacctgggaacctctgggatcccaccttccctccctgaaactacancnnctgnccctctcctgntnccnttcaccntcaacttnaccatcaccaacctgcantangnggannacatgcnncncccnggntccaggaagttcaacaccacngagagggttctgcagggtctgctcaagcccttgttcaagagcaccagtgttggccctctgtattctggctgcagactgaccttgctcaggcctgagaaggacggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcactaacctgcagtatgaggaggacatgcatcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggccactatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctccaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgaagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtctagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcggaaaaaaaaaaaaaaa

SEQ ID NO: 315 - protein, 22152 aa, Homo sapiens
  misc_feature (13880)..(13880): Xaa can be any naturally occurring amino acid
  misc_feature (13887)..(13887): Xaa can be any naturally occurring amino acid
  misc_feature (13890)..(13891): Xaa can be any naturally occurring amino acid
  misc_feature (13893)..(13893): Xaa can be any naturally occurring amino acid
  misc_feature (13899)..(13899): Xaa can be any naturally occurring amino acid
  misc_feature (13903)..(13903): Xaa can be any naturally occurring amino acid
  misc_feature (13911)..(13918): Xaa can be any naturally occurring amino acid
  misc_feature (13926)..(13926): Xaa can be any naturally occurring amino acid
  misc_feature (13928)..(13928): Xaa can be any naturally occurring amino acid
  misc_feature (13930)..(13930): Xaa can be any naturally occurring amino acid
  misc_feature (13936)..(13938): Xaa can be any naturally occurring amino acid
  misc_feature (13940)..(13941): Xaa can be any naturally occurring amino acid
  misc_feature (14569)..(14571): Xaa can be any naturally occurring amino acid
  misc_feature (14575)..(14575): Xaa can be any naturally occurring amino acid
  misc_feature (14587)..(14587): Xaa can be any naturally occurring amino acid
  misc_feature (14591)..(14591): Xaa can be any naturally occurring amino acid
  misc_feature (14593)..(14594): Xaa can be any naturally occurring amino acid
  misc_feature (14725)..(14727): Xaa can be any naturally occurring amino acid
  misc_feature (14731)..(14731): Xaa can be any naturally occurring amino acid
  misc_feature (14743)..(14743): Xaa can be any naturally occurring amino acid
  misc_feature (14747)..(14747): Xaa can be any naturally occurring amino acid
  misc_feature (14749)..(14750): Xaa can be any naturally occurring amino acid
  misc_feature (15661)..(15663): Xaa can be any naturally occurring amino acid
  misc_feature (15667)..(15667): Xaa can be any naturally occurring amino acid
  misc_feature (15679)..(15679): Xaa can be any naturally occurring amino acid
  misc_feature (15683)..(15683): Xaa can be any naturally occurring amino acid
  misc_feature (15685)..(15686): Xaa can be any naturally occurring amino acid
  misc_feature (15972)..(15974): Xaa can be any naturally occurring amino acid
  misc_feature (15978)..(15978): Xaa can be any naturally occurring amino acid
  misc_feature (15990)..(15990): Xaa can be any naturally occurring amino acid
  misc_feature (15994)..(15994): Xaa can be any naturally occurring amino acid
  misc_feature (15996)..(15997): Xaa can be any naturally occurring amino acid
  misc_feature (16015)..(16015): Xaa can be any naturally occurring amino acid
  misc_feature (16017)..(16017): Xaa can be any naturally occurring amino acid
  misc_feature (16020)..(16020): Xaa can be any naturally occurring amino acid
  misc_feature (16025)..(16025): Xaa can be any naturally occurring amino acid
  misc_feature (16037)..(16037): Xaa can be any naturally occurring amino acid
  misc_feature (16040)..(16041): Xaa can be any naturally occurring amino acid
  misc_feature (16045)..(16045): Xaa can be any naturally occurring amino acid
  misc_feature (16048)..(16049): Xaa can be any naturally occurring amino acid
  misc_feature (16051)..(16054): Xaa can be any naturally occurring amino acid
  misc_feature (16057)..(16058): Xaa can be any naturally occurring amino acid
  misc_feature (16065)..(16065): Xaa can be any naturally occurring amino acid
  misc_feature (16072)..(16072): Xaa can be any naturally occurring amino acid
  misc_feature (16075)..(16076): Xaa can be any naturally occurring amino acid
  misc_feature (16078)..(16078): Xaa can be any naturally occurring amino acid
  misc_feature (16084)..(16084): Xaa can be any naturally occurring amino acid
  misc_feature (16088)..(16088): Xaa can be any naturally occurring amino acid
  misc_feature (16376)..(16376): Xaa can be any naturally occurring amino acid
  misc_feature (16383)..(16383): Xaa can be any naturally occurring amino acid
  misc_feature (16386)..(16387): Xaa can be any naturally occurring amino acid
  misc_feature (16389)..(16389): Xaa can be any naturally occurring amino acid
  misc_feature (16395)..(16395): Xaa can be any naturally occurring amino acid
  misc_feature (16399)..(16399): Xaa can be any naturally occurring amino acid
  misc_feature (16407)..(16414): Xaa can be any naturally occurring amino acid
  misc_feature (16422)..(16422): Xaa can be any naturally occurring amino acid
  misc_feature (16424)..(16424): Xaa can be any naturally occurring amino acid
  misc_feature (16426)..(16426): Xaa can be any naturally occurring amino acid
  misc_feature (16432)..(16434): Xaa can be any naturally occurring amino acid
  misc_feature (16436)..(16437): Xaa can be any naturally occurring amino acid
  misc_feature (16439)..(16441): Xaa can be any naturally occurring amino acid
  misc_feature (16445)..(16445): Xaa can be any naturally occurring amino acid
  misc_feature (16457)..(16457): Xaa can be any naturally occurring amino acid
  misc_feature (16461)..(16461): Xaa can be any naturally occurring amino acid
  misc_feature (16463)..(16464): Xaa can be any naturally occurring amino acid
  misc_feature (16844)..(16844): Xaa can be any naturally occurring amino acid
  misc_feature (16851)..(16851): Xaa can be any naturally occurring amino acid
  misc_feature (16854)..(16855): Xaa can be any naturally occurring amino acid
  misc_feature (16857)..(16857): Xaa can be any naturally occurring amino acid
  misc_feature (16863)..(16863): Xaa can be any naturally occurring amino acid
  misc_feature (16867)..(16867): Xaa can be any naturally occurring amino acid
  misc_feature (16875)..(16882): Xaa can be any naturally occurring amino acid
  misc_feature (16890)..(16890): Xaa can be any naturally occurring amino acid
  misc_feature (16892)..(16892): Xaa can be any naturally occurring amino acid
  misc_feature (16894)..(16894): Xaa can be any naturally occurring amino acid
  misc_feature (16900)..(16902): Xaa can be any naturally occurring amino acid
  misc_feature (16904)..(16905): Xaa can be any naturally occurring amino acid
  misc_feature (16907)..(16909): Xaa can be any naturally occurring amino acid
  misc_feature (16913)..(16913): Xaa can be any naturally occurring amino acid
  misc_feature (16925)..(16925): Xaa can be any naturally occurring amino acid
  misc_feature (16929)..(16929): Xaa can be any naturally occurring amino acid
  misc_feature (16931)..(16932): Xaa can be any naturally occurring amino acid
  misc_feature (17468)..(17468): Xaa can be any naturally occurring amino acid
  misc_feature (17475)..(17475): Xaa can be any naturally occurring amino acid
  misc_feature (17478)..(17479): Xaa can be any naturally occurring amino acid
  misc_feature (17481)..(17481): Xaa can be any naturally occurring amino acid
  misc_feature (17487)..(17487): Xaa can be any naturally occurring amino acid
  misc_feature (17491)..(17491): Xaa can be any naturally occurring amino acid
  misc_feature (17499)..(17506): Xaa can be any naturally occurring amino acid
  misc_feature (17514)..(17514): Xaa can be any naturally occurring amino acid
  misc_feature (17516)..(17516): Xaa can be any naturally occurring amino acid
  misc_feature (17518)..(17518): Xaa can be any naturally occurring amino acid
  misc_feature (17524)..(17526): Xaa can be any naturally occurring amino acid
  misc_feature (17528)..(17529): Xaa can be any naturally occurring amino acid
  misc_feature (17531)..(17533): Xaa can be any naturally occurring amino acid
  misc_feature (17537)..(17537): Xaa can be any naturally occurring amino acid
  misc_feature (17549)..(17549): Xaa can be any naturally occurring amino acid
  misc_feature (17553)..(17553): Xaa can be any naturally occurring amino acid
  misc_feature (17555)..(17556): Xaa can be any naturally occurring amino acid
  misc_feature (17574)..(17574): Xaa can be any naturally occurring amino acid
  misc_feature (17576)..(17576): Xaa can be any naturally occurring amino acid
  misc_feature (17579)..(17579): Xaa can be any naturally occurring amino acid
  misc_feature (17584)..(17584): Xaa can be any naturally occurring amino acid
  misc_feature (17596)..(17596): Xaa can be any naturally occurring amino acid
  misc_feature (17599)..(17600): Xaa can be any naturally occurring amino acid
  misc_feature (17604)..(17604): Xaa can be any naturally occurring amino acid
  misc_feature (17607)..(17608): Xaa can be any naturally occurring amino acid
  misc_feature (17610)..(17613): Xaa can be any naturally occurring amino acid
  misc_feature (17616)..(17617): Xaa can be any naturally occurring amino acid
  misc_feature (17624)..(17624): Xaa can be any naturally occurring amino acid
  misc_feature (17631)..(17631): Xaa can be any naturally occurring amino acid
  misc_feature (17780)..(17780): Xaa can be any naturally occurring amino acid
  misc_feature (17787)..(17787): Xaa can be any naturally occurring amino acid
  misc_feature (17790)..(17791): Xaa can be any naturally occurring amino acid
  misc_feature (17793)..(17793): Xaa can be any naturally occurring amino acid
  misc_feature (17799)..(17799): Xaa can be any naturally occurring amino acid
  misc_feature (17803)..(17803): Xaa can be any naturally occurring amino acid
  misc_feature (17811)..(17818): Xaa can be any naturally occurring amino acid
  misc_feature (17826)..(17826): Xaa can be any naturally occurring amino acid
  misc_feature (17828)..(17828): Xaa can be any naturally occurring amino acid
  misc_feature (17830)..(17830): Xaa can be any naturally occurring amino acid
  misc_feature (17836)..(17838): Xaa can be any naturally occurring amino acid
  misc_feature (17840)..(17841): Xaa can be any naturally occurring amino acid
  misc_feature (17843)..(17845): Xaa can be any naturally occurring amino acid
  misc_feature (17849)..(17849): Xaa can be any naturally occurring amino acid
  misc_feature (17861)..(17861): Xaa can be any naturally occurring amino acid
  misc_feature (17865)..(17865): Xaa can be any naturally occurring amino acid
  misc_feature (17867)..(17868): Xaa can be any naturally occurring amino acid
  misc_feature (17886)..(17886): Xaa can be any naturally occurring amino acid
  misc_feature (17888)..(17888): Xaa can be any naturally occurring amino acid
  misc_feature (17891)..(17891): Xaa can be any naturally occurring amino acid
  misc_feature (17896)..(17896): Xaa can be any naturally occurring amino acid
  misc_feature (17908)..(17908): Xaa can be any naturally occurring amino acid
  misc_feature (17911)..(17912): Xaa can be any naturally occurring amino acid
  misc_feature (17916)..(17916): Xaa can be any naturally occurring amino acid
  misc_feature (17919)..(17920): Xaa can be any naturally occurring amino acid
  misc_feature (17922)..(17925): Xaa can be any naturally occurring amino acid
  misc_feature (17928)..(17929): Xaa can be any naturally occurring amino acid
  misc_feature (17936)..(17936): Xaa can be any naturally occurring amino acid
  misc_feature (17943)..(17943): Xaa can be any naturally occurring amino acid
  misc_feature (17946)..(17947): Xaa can be any naturally occurring amino acid
  misc_feature (17949)..(17949): Xaa can be any naturally occurring amino acid
  misc_feature (17955)..(17955): Xaa can be any naturally occurring amino acid
  misc_feature (17959)..(17959): Xaa can be any naturally occurring amino acid
  misc_feature (18092)..(18092): Xaa can be any naturally occurring amino acid
  misc_feature (18099)..(18099): Xaa can be any naturally occurring amino acid
  misc_feature (18102)..(18103): Xaa can be any naturally occurring amino acid
  misc_feature (18105)..(18105): Xaa can be any naturally occurring amino acid
  misc_feature (18111)..(18111): Xaa can be any naturally occurring amino acid
  misc_feature (18115)..(18115): Xaa can be any naturally occurring amino acid
  misc_feature (18123)..(18130): Xaa can be any naturally occurring amino acid
  misc_feature (18138)..(18138): Xaa can be any naturally occurring amino acid
  misc_feature (18140)..(18140): Xaa can be any naturally occurring amino acid
  misc_feature (18142)..(18142): Xaa can be any naturally occurring amino acid
  misc_feature (18148)..(18150): Xaa can be any naturally occurring amino acid
  misc_feature (18152)..(18153): Xaa can be any naturally occurring amino acid
  misc_feature (18155)..(18157): Xaa can be any naturally occurring amino acid
  misc_feature (18161)..(18161): Xaa can be any naturally occurring amino acid
  misc_feature (18173)..(18173): Xaa can be any naturally occurring amino acid
  misc_feature (18177)..(18177): Xaa can be any naturally occurring amino acid
  misc_feature (18179)..(18180): Xaa can be any naturally occurring amino acid
  misc_feature (18198)..(18198): Xaa can be any naturally occurring amino acid
  misc_feature (18200)..(18200): Xaa can be any naturally occurring amino acid
  misc_feature (18203)..(18203): Xaa can be any naturally occurring amino acid
  misc_feature (18208)..(18208): Xaa can be any naturally occurring amino acid
  misc_feature (18220)..(18220): Xaa can be any naturally occurring amino acid
  misc_feature (18223)..(18224): Xaa can be any naturally occurring amino acid
  misc_feature (18228)..(18228): Xaa can be any naturally occurring amino acid
  misc_feature (18231)..(18232): Xaa can be any naturally occurring amino acid
  misc_feature (18234)..(18237): Xaa can be any naturally occurring amino acid
  misc_feature (18240)..(18241): Xaa can be any naturally occurring amino acid
  misc_feature (18248)..(18248): Xaa can be any naturally occurring amino acid
  misc_feature (18255)..(18255): Xaa can be any naturally occurring amino acid
  misc_feature (18258)..(18259): Xaa can be any naturally occurring amino acid
  misc_feature (18261)..(18261): Xaa can be any naturally occurring amino acid
  misc_feature (18267)..(18267): Xaa can be any naturally occurring amino acid
  misc_feature (18271)..(18271): Xaa can be any naturally occurring amino acid
  misc_feature (18404)..(18404): Xaa can be any naturally occurring amino acid
  misc_feature (18411)..(18411): Xaa can be any naturally occurring amino acid
  misc_feature (18414)..(18415): Xaa can be any naturally occurring amino acid
  misc_feature (18417)..(18417): Xaa can be any naturally occurring amino acid
  misc_feature (18423)..(18423): Xaa can be any naturally occurring amino acid
  misc_feature (18427)..(18427): Xaa can be any naturally occurring amino acid
  misc_feature (18435)..(18442): Xaa can be any naturally occurring amino acid
  misc_feature (18450)..(18450): Xaa can be any naturally occurring amino acid
  misc_feature (18452)..(18452): Xaa can be any naturally occurring amino acid
  misc_feature (18454)..(18454): Xaa can be any naturally occurring amino acid
  misc_feature (18460)..(18462): Xaa can be any naturally occurring amino acid
  misc_feature (18464)..(18465): Xaa can be any naturally occurring amino acid
  misc_feature (18467)..(18469): Xaa can be any naturally occurring amino acid
  misc_feature (18473)..(18473): Xaa can be any naturally occurring amino acid
  misc_feature (18485)..(18485): Xaa can be any naturally occurring amino acid
  misc_feature (18489)..(18489): Xaa can be any naturally occurring amino acid
  misc_feature (18491)..(18492): Xaa can be any naturally occurring amino acid
  misc_feature (18510)..(18510): Xaa can be any naturally occurring amino acid
  misc_feature (18512)..(18512): Xaa can be any naturally occurring amino acid
  misc_feature (18515)..(18515): Xaa can be any naturally occurring amino acid
  misc_feature (18520)..(18520): Xaa can be any naturally occurring amino acid
  misc_feature (18532)..(18532): Xaa can be any naturally occurring amino acid
  misc_feature (18535)..(18536): Xaa can be any naturally occurring amino acid
  misc_feature (18540)..(18540): Xaa can be any naturally occurring amino acid
  misc_feature (18543)..(18544): Xaa can be any naturally occurring amino acid
  misc_feature (18546)..(18549): Xaa can be any naturally occurring amino acid
  misc_feature (18552)..(18553): Xaa can be any naturally occurring amino acid
  misc_feature (18560)..(18560): Xaa can be any naturally occurring amino acid
  misc_feature (18567)..(18567): Xaa can be any naturally occurring amino acid
  misc_feature (18570)..(18571): Xaa can be any naturally occurring amino acid
  misc_feature (18573)..(18573): Xaa can be any naturally occurring amino acid
  misc_feature (18579)..(18579): Xaa can be any naturally occurring amino acid
  misc_feature (18583)..(18583): Xaa can be any naturally occurring amino acid
  misc_feature (18716)..(18716): Xaa can be any naturally occurring amino acid
  misc_feature (18723)..(18723): Xaa can be any naturally occurring amino acid
  misc_feature (18726)..(18727): Xaa can be any naturally occurring amino acid
  misc_feature (18729)..(18729): Xaa can be any naturally occurring amino acid
  misc_feature (18735)..(18735): Xaa can be any naturally occurring amino acid
  misc_feature (18739)..(18739): Xaa can be any naturally occurring amino acid
  misc_feature (18747)..(18754): Xaa can be any naturally occurring amino acid
  misc_feature (18762)..(18762): Xaa can be any naturally occurring amino acid
  misc_feature (18764)..(18764): Xaa can be any naturally occurring amino acid
  misc_feature (18766)..(18766): Xaa can be any naturally occurring amino acid
  misc_feature (18772)..(18774): Xaa can be any naturally occurring amino acid
  misc_feature (18776)..(18777): Xaa can be any naturally occurring amino acid
  misc_feature (18779)..(18781): Xaa can be any naturally occurring amino acid
  misc_feature (18785)..(18785): Xaa can be any naturally occurring amino acid
  misc_feature (18797)..(18797): Xaa can be any naturally occurring amino acid
  misc_feature (18801)..(18801): Xaa can be any naturally occurring amino acid
  misc_feature (18803)..(18804): Xaa can be any naturally occurring amino acid
  misc_feature (18822)..(18822): Xaa can be any naturally occurring amino acid
  misc_feature (18824)..(18824): Xaa can be any naturally occurring amino acid
  misc_feature (18827)..(18827): Xaa can be any naturally occurring amino acid
  misc_feature (18832)..(18832): Xaa can be any naturally occurring amino acid
  misc_feature (18844)..(18844): Xaa can be any naturally occurring amino acid
  misc_feature (18847)..(18848): Xaa can be any naturally occurring amino acid
  misc_feature (18852)..(18852): Xaa can be any naturally occurring amino acid
  misc_feature (18855)..(18856): Xaa can be any naturally occurring amino acid
  misc_feature (18858)..(18861): Xaa can be any naturally occurring amino acid
  misc_feature (18864)..(18865): Xaa can be any naturally occurring amino acid
  misc_feature (18872)..(18872): Xaa can be any naturally occurring amino acid
  misc_feature (18879)..(18879): Xaa can be any naturally occurring amino acid
  misc_feature (18882)..(18883): Xaa can be any naturally occurring amino acid
  misc_feature (18885)..(18885): Xaa can be any naturally occurring amino acid
  misc_feature (18891)..(18891): Xaa can be any naturally occurring amino acid
  misc_feature (18895)..(18895): Xaa can be any naturally occurring amino acid
  misc_feature (19091)..(19093): Xaa can be any naturally occurring amino acid
  misc_feature (19097)..(19097): Xaa can be any naturally occurring amino acid
  misc_feature (19109)..(19109): Xaa can be any naturally occurring amino acid
  misc_feature (19113)..(19113): Xaa can be any naturally occurring amino acid
  misc_feature (19115)..(19116): Xaa can be any naturally occurring amino acid
  misc_feature (19134)..(19134): Xaa can be any naturally occurring amino acid
  misc_feature (19136)..(19136): Xaa can be any naturally occurring amino acid
  misc_feature (19139)..(19139): Xaa can be any naturally occurring amino acid
  misc_feature (19144)..(19144): Xaa can be any naturally occurring amino acid
  misc_feature (19156)..(19156): Xaa can be any naturally occurring amino acid
  misc_feature (19159)..(19160): Xaa can be any naturally occurring amino acid
  misc_feature (19164)..(19164): Xaa can be any naturally occurring amino acid
  misc_feature (19167)..(19168): Xaa can be any naturally occurring amino acid
  misc_feature (19170)..(19173): Xaa can be any naturally occurring amino acid
  misc_feature (19176)..(19177): Xaa can be any naturally occurring amino acid
  misc_feature (19184)..(19184): Xaa can be any naturally occurring amino acid
  misc_feature (19191)..(19191): Xaa can be any naturally occurring amino acid
  misc_feature (19194)..(19195): Xaa can be any naturally occurring amino acid
  misc_feature (19197)..(19197): Xaa can be any naturally occurring amino acid
  misc_feature (19203)..(19203): Xaa can be any naturally occurring amino acid
  misc_feature (19207)..(19207): Xaa can be any naturally occurring amino acid
  misc_feature (19340)..(19340): Xaa can be any naturally occurring amino acid
  misc_feature (19347)..(19347): Xaa can be any naturally occurring amino acid
  misc_feature (19350)..(19351): Xaa can be any naturally occurring amino acid
  misc_feature (19353)..(19353): Xaa can be any naturally occurring amino acid
  misc_feature (19359)..(19359): Xaa can be any naturally occurring amino acid
  misc_feature (19363)..(19363): Xaa can be any naturally occurring amino acid
  misc_feature (19371)..(19378): Xaa can be any naturally occurring amino acid
  misc_feature (19386)..(19386): Xaa can be any naturally occurring amino acid
  misc_feature (19388)..(19388): Xaa can be any naturally occurring amino acid
  misc_feature (19390)..(19390): Xaa can be any naturally occurring amino acid
  misc_feature (19396)..(19398): Xaa can be any naturally occurring amino acid
  misc_feature (19400)..(19401): Xaa can be any naturally occurring amino acid
  misc_feature (19403)..(19405): Xaa can be any naturally occurring amino acid
  misc_feature (19409)..(19409): Xaa can be any naturally occurring amino acid
  misc_feature (19421)..(19421): Xaa can be any naturally occurring amino acid
  misc_feature (19425)..(19425): Xaa can be any naturally occurring amino acid
  misc_feature (19427)..(19428): Xaa can be any naturally occurring amino acid
  misc_feature (19446)..(19446): Xaa can be any naturally occurring amino acid
  misc_feature (19448)..(19448): Xaa can be any naturally occurring amino acid
  misc_feature (19451)..(19451): Xaa can be any naturally occurring amino acid
  misc_feature (19456)..(19456): Xaa can be any naturally occurring amino acid
  misc_feature (19468)..(19468): Xaa can be any naturally occurring amino acid
  misc_feature (19471)..(19472): Xaa can be any naturally occurring amino acid
  misc_feature (19476)..(19476): Xaa can be any naturally occurring amino acid
  misc_feature (19479)..(19480): Xaa can be any naturally occurring amino acid
  misc_feature (19482)..(19485): Xaa can be any naturally occurring amino acid
  misc_feature (19488)..(19489): Xaa can be any naturally occurring amino acid
  misc_feature (19496)..(19496): Xaa can be any naturally occurring amino acid
  misc_feature (19503)..(19503): Xaa can be any naturally occurring amino acid
  misc_feature (19506)..(19507): Xaa can be any naturally occurring amino acid
  misc_feature (19509)..(19509): Xaa can be any naturally occurring amino acid
  misc_feature (19515)..(19515): Xaa can be any naturally occurring amino acid
  misc_feature (19519)..(19519): Xaa can be any naturally occurring amino acid
  misc_feature (19652)..(19652): Xaa can be any naturally occurring amino acid
  misc_feature (19659)..(19659): Xaa can be any naturally occurring amino acid
  misc_feature (19662)..(19663): Xaa can be any naturally occurring amino acid
  misc_feature (19665)..(19665): Xaa can be any naturally occurring amino acid
  misc_feature (19671)..(19671): Xaa can be any naturally occurring amino acid
  misc_feature (19675)..(19675): Xaa can be any naturally occurring amino acid
  misc_feature (19683)..(19690): Xaa can be any naturally occurring amino acid
  misc_feature (19698)..(19698): Xaa can be any naturally occurring amino acid
  misc_feature (19700)..(19700): Xaa can be any naturally occurring amino acid
  misc_feature (19702)..(19702): Xaa can be any naturally occurring amino acid
  misc_feature (19708)..(19710): Xaa can be any naturally occurring amino acid
  misc_feature (19712)..(19713): Xaa can be any naturally occurring amino acid
  misc_feature (19715)..(19717): Xaa can be any naturally occurring amino acid
  misc_feature (19721)..(19721): Xaa can be any naturally occurring amino acid
  misc_feature (19733)..(19733): Xaa can be any naturally occurring amino acid
  misc_feature (19737)..(19737): Xaa can be any naturally occurring amino acid
  misc_feature (19739)..(19740): Xaa can be any naturally occurring amino acid
  misc_feature (19758)..(19758): Xaa can be any naturally occurring amino acid
  misc_feature (19760)..(19760): Xaa can be any naturally occurring amino acid
  misc_feature (19763)..(19763): Xaa can be any naturally occurring amino acid
  misc_feature (19768)..(19768): Xaa can be any naturally occurring amino acid
  misc_feature (19780)..(19780): Xaa can be any naturally occurring amino acid
  misc_feature (19783)..(19784): Xaa can be any naturally occurring amino acid
  misc_feature (19788)..(19788): Xaa can be any naturally occurring amino acid
  misc_feature (19791)..(19792): Xaa can be any naturally occurring amino acid
  misc_feature (19794)..(19797): Xaa can be any naturally occurring amino acid
  misc_feature (19800)..(19801): Xaa can be any naturally occurring amino acid
  misc_feature (19808)..(19808): Xaa can be any naturally occurring amino acid
  misc_feature (19815)..(19815): Xaa can be any naturally occurring amino acid
  misc_feature (19818)..(19819): Xaa can be any naturally occurring amino acid
  misc_feature (19821)..(19821): Xaa can be any naturally occurring amino acid
  misc_feature (19827)..(19827): Xaa can be any naturally occurring amino acid
  misc_feature (19831)..(19831): Xaa can be any naturally occurring amino acid
  misc_feature (19963)..(19963): Xaa can be any naturally occurring amino acid
  misc_feature (19970)..(19970): Xaa can be any naturally occurring amino acid
  misc_feature (19973)..(19974): Xaa can be any naturally occurring amino acid
  misc_feature (19976)..(19976): Xaa can be any naturally occurring amino acid
  misc_feature (19982)..(19982): Xaa can be any naturally occurring amino acid
  misc_feature (19986)..(19986): Xaa can be any naturally occurring amino acid
  misc_feature (19994)..(20001): Xaa can be any naturally occurring amino acid
  misc_feature (20009)..(20009): Xaa can be any naturally occurring amino acid
  misc_feature (20011)..(20011): Xaa can be any naturally occurring amino acid
  misc_feature (20013)..(20013): Xaa can be any naturally occurring amino acid
  misc_feature (20019)..(20021): Xaa can be any naturally occurring amino acid
  misc_feature (20023)..(20024): Xaa can be any naturally occurring amino acid
  misc_feature (20026)..(20028): Xaa can be any naturally occurring amino acid
  misc_feature (20032)..(20032): Xaa can be any naturally occurring amino acid
  misc_feature (20044)..(20044): Xaa can be any naturally occurring amino acid
  misc_feature (20048)..(20048): Xaa can be any naturally occurring amino acid
  misc_feature (20050)..(20051): Xaa can be any naturally occurring amino acid
  misc_feature (20069)..(20069): Xaa can be any naturally occurring amino acid
  misc_feature (20071)..(20071): Xaa can be any naturally occurring amino acid
  misc_feature (20074)..(20074): Xaa can be any naturally occurring amino acid
  misc_feature (20079)..(20079): Xaa can be any naturally occurring amino acid
  misc_feature (20091)..(20091): Xaa can be any naturally occurring amino acid
  misc_feature (20094)..(20095): Xaa can be any naturally occurring amino acid
  misc_feature (20099)..(20099): Xaa can be any naturally occurring amino acid
  misc_feature (20102)..(20103): Xaa can be any naturally occurring amino acid
  misc_feature (20105)..(20108): Xaa can be any naturally occurring amino acid
  misc_feature (20111)..(20112): Xaa can be any naturally occurring amino acid
  misc_feature (20119)..(20119): Xaa can be any naturally occurring amino acid
  misc_feature (20126)..(20126): Xaa can be any naturally occurring amino acid
  misc_feature (20129)..(20130): Xaa can be any naturally occurring amino acid
  misc_feature (20132)..(20132): Xaa can be any naturally occurring amino acid
  misc_feature (20138)..(20138): Xaa can be any naturally occurring amino acid
  misc_feature (20142)..(20142): Xaa can be any naturally occurring amino acid
  misc_feature (20275)..(20275): Xaa can be any naturally occurring amino acid
  misc_feature (20282)..(20282): Xaa can be any naturally occurring amino acid
  misc_feature (20285)..(20286): Xaa can be any naturally occurring amino acid
  misc_feature (20288)..(20288): Xaa can be any naturally occurring amino acid
  misc_feature (20294)..(20294): Xaa can be any naturally occurring amino acid
  misc_feature (20298)..(20298): Xaa can be any naturally occurring amino acid
  misc_feature (20306)..(20313): Xaa can be any naturally occurring amino acid
  misc_feature (20321)..(20321): Xaa can be any naturally occurring amino acid
  misc_feature (20323)..(20323): Xaa can be any naturally occurring amino acid
  misc_feature (20325)..(20325): Xaa can be any naturally occurring amino acid
  misc_feature (20331)..(20333): Xaa can be any naturally occurring amino acid
  misc_feature (20335)..(20336): Xaa can be any naturally occurring amino acid
  misc_feature (20806)..(20808): Xaa can be any naturally occurring amino acid
  misc_feature (20812)..(20812): Xaa can be any naturally occurring amino acid
  misc_feature (20824)..(20824): Xaa can be any naturally occurring amino acid
  misc_feature (20828)..(20828): Xaa can be any naturally occurring amino acid
  misc_feature (20830)..(20831): Xaa can be any naturally occurring amino acid
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTINLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTDTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWASVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPSTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGTSPAGTSPGSPEVSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVPTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLKDPEYAGHKLGIWDDFIPKFGKAAHMRELPLLSPPQDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGHRTEITSYKRISSSFLAQSMRSSDSPSEAITRLSNFPAMTESGGMILAMQTSPPGATSISAPTLDTSATASWTGTPLATTQRFTYSEKTTLFSKGREDTSQPSPPCVEETSSSSSVVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVTWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVISSSKISTPDHDKSTVPPDTFTGEIPRVFTSSIKTKSAEMTITTQASPPESASHSTLPLDTSTTLSQGGTHSTVSQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTASTLGDTSVSTSTPNISQTNQIQTEPTASLSPRLRESSTSEKTSSTTETNTAFSYVPTGAITQASRTEISSSRTSISDLDRSTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPEPVTSSPPNLSSPTQERLTTYKDTAHTEAMHASMHTNTAVANVGTSISGHESQSSVPADSHTSKATSPMGITFAMGDTSVYTSTPAFFETRIQSESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAMANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSLAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHVILTTDEDTTAIEAMHPSTSTAATNVETTCSGHGSQSSVLTDSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSFGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSPLTPGQVKTTEVLDASAEPETSSPPSLSSTSVEILATSEVTTDTEKIHPFPNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDTSTRTVSWFSTSPVMTESAEITMNTHTSPLGATTQGTSTLDTSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLTPGLVITTDRMGISREPGTSSTSNLSSTSHERLTTLEDTVDTEAMQPSTHTAVTNVRTSISGHESQSSVLSDSETPKATSSMGTTYTMGETSVSISTSDFFETSRVQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSALPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKAESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILATTEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLATSKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMSSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRTHIPDSDQSTMSPDIITEVITRLSSSSMMSESTQMTITTQKSSPGATAQSTLTLATTTAPLARTHSTVPPRFLHSEMTTLMSRSPENPSWKSSPFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSTPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASRQMASTILTEMMITTPYVFPDVPETTSSLATSLGAETSTALPRTTPSVLNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTAAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREQLYWELSQLTNGIKELGPYTLDRNSLYVNGFTHWIPVPTSSTPGTSTVDLGSGTPSSLPSPTAAGPLLVPFTLNFTITNLQYEEDMHHPGSRKFNTTERVLQGLLGPMFKNTSVGLLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMRHPGSRKFNTTERVLQGLLKPLFKSTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLPGHTAPVPLLIPFTLNFTITNLHYEENMQHPGSRKFNTTERVLQGLLKPLFKNTSVGPLYSGCRLTLLRPEKHEAATGVDTICTHRVDPIGPGLDREXLYWELSXLTXXIXELGPYXLDRXSLYVNGFXXXXXXXXTSTPGTSXVXLXTSGTPXXXPXXTSAGPLLVPFTLNFTITNLQYEEDMHHPGSRKFNTTERVLQGLLGPMFKNTSVGLLYSGCRLTLLRPEKNGAATGMDAICSHRLDPKSPGLDREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQSSMTTTRTPDTSTMHLATSRTPASLSGPTTASPLLVLFTINCTITNLQYEEDMRRTGSRKFNTMESVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDLRTSGTPSSLSSPTIMXXXPLLXPFTLNFTITNLXYEEXMXXPGSRKFNTTERVLQGLLRPLFKNTSVSSLYSGCRLTLLRPEKDGAATRVDAACTYRPDPKSPGLDREQLYWELSQLTHSITELGPYTLDRVSLYVNGFNPRSSVPTTSTPGTSTVHLATSGTPSSLPGHTXXXPLLXPFTLNFTITNLXYEEXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSFLTTSTPWTSTVDLGTSGTPSPVPSPTTAGPLLVPFTLNFTITNLQYEEDMHRPGSRRFNTTERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFSTTERVLQGLLKPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNQRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRTSVPTTSTPGTSTVDLGTSGTPFSLPSPAXXXPLLXPFTLNFTITNLXYEEXMXXPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSLPSSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTSLRSEKDGAATGVDAICTHRVDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLIPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETTGTPSSFPGHTEPGPLLIPFTFNFTITNLRYEENMQHPGSRKFNTTERVLQGLLTPLFKNTSVGPLYSGCRLTLLRPEKQEAATGVDTICTHRVDPIGPGLDRERLYWELSQLTNSITELGPYTLDRDSLYVDGFNPWSSVPTTSTPGTSTVHLATSGTPSPLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSITELGPYTLDRDSLYVNGFNPWSSVPTTSTPGTSTVHLATSGTPSSLPGHTTAGPLLVPFTLNFTITNLKYEEDMHCPGSRKFNTTERVLQSLHGPMFKNTSVGPLYSGCRLTLLRSEKDGAATGVDAICTHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTNSITELGPYTLDRDSLYVNGFTHRSSMPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFHPRSSVPTTSTPGTSTVHLATSGTPSSLPGHTAPVPLLIPFTLNFTITNLHYEENMQHPGSRKFNTTERVLQGLLGPMFKNTSVGLLYSGCRLTLLRPEKNGAATGMDAICSHRLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHQNSVPTTSTPGTSTVYWATTGTPSSFPGHTEPGPLLIPFTFNFTITNLHYEENMQHPGSRKFNTTERVLQGLLTPLFKNTSVGPLYSGCRLTLLRPEKQEAATGVDTICTHRVDPIGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRSSVPTTSSPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRTSVPTTSTPGTSTVHLATSGTPSSLPGHTAPVPLLIPFTLNFTITNLQYEEDMHRPGSRKFNTTERVLQGLLSPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWSSGLTTSTPWTSTVDLGTSGTPSPVPSPTTAGPLLVPFTLNFTITNLQYEEDMHRPGSRKFNATERVLQGLLSPIFKNTSVGPLYSGCRLTLLRPEKQEAATGVDTICTHRVDPIGPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHRSFGLTTSTPWTSTVDLGTSGTPSPVPSPTTAGPLLVPFTLNFTITNLQYEEDMHRPGSRKFNTTERVLQGLLTPLFRNTSVSSLYSGCRLTLLRPEKDGAATRVDAVCTHRPDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHWIPVPTSSTPGTSTVDLGSGTPSSLPSPTTAGPLLVPFTLNFTITNLQYGEDMGHPGSRKFNTTERVLQGLLGPIFKNTSVGPLYSGCRLTSLRSEKDGAATGVDAICIHHLDPKSPGLDREXLYWELSXLTXXIXELGPYXLDRXSLYVNGFXXXXXXXXTSTPGTSXVXLXTSGTPXXXPXXTXXXPLLXPFTLNFTITNLXYEEXMXXPGSRKFNTTERVLQGLLXPXFKXTSVGXLYSGCRLTLLRXEKXXAATXVDXXCXXXXDPXXPGLDREXLYWELSXLTXXIXELGPYXLDRXSLYVNGFTHQTFAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATRVDAVCTHRPDPKSPGLDREXLYWELSXLTXXIXELGPYXLDRXSLYVNGFXXXXXXXXTSTPGTSXVXLXTSGTPXXXPXXTAPVPLLIPFTLNFTITNLHYEENMQHPGSRKFNTTERVLQGLLRPLFKSTSVGPLYSGCRLTLLRPEKHGAATGVDAICTLRLDPTGPGLDRERLYWELSQLTNSVTELGPYTLDRDSLYVNGFTQRSSVPTTSIPGTSAVHLETSGTPASLPGHTAPGPLLVPFTLNFTITNLQYEVDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTXXXPLLXPFTLNFTITNLXYEEXMXXPGSRKFNTTERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTQDRDSLYNVGFTQRSSVPTTSVPGTPTVDLGTSGTPVSKPGPSAASPLLVLFTLNGTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

We claim:
1. A purified polypeptide comprising a fragment of CA125 selected from the group consisting of:
   (i) residues 1-1637 of SEQ ID NO:299;
   (ii) a repeat unit selected from repeat units 1-7, 10-13, 15-19, and 21-60 of Table 16;
   (iii) SEQ ID NOS: 164, 167, 169, 170, 171, 172, 174, 175, 178, 180, 181, 187, 189, 190, 195, 196, 199, 200, 204, 206, 208, 210, 213, 214, 217, 219, 223, 228, 229, 230, 231, 234, 235, 237, 241, 243, 244, 246, 251, 252, 254, 258, 259, 264, 269, 270, 271, 275, 279, 282, 288, and 291; and
   (iv) residues 11132-11721 of SEQ ID NO:162;
   wherein the polypeptide does not comprise of consist of full-length polypeptide of native CA125 and the polypeptide does not consist of SEQ ID NO:162.

2. The purified polypeptide of claim 1 wherein the polypeptide comprises a fragment of CA125 selected from the group consisting of
   (iii) SEQ ID NOS: 164, 167, 169, 170, 171, 172, 174, 175, 178, 180, 181, 187, 189, 190, 195, 196, 199, 200, 204, 206, 208, 210, 213, 214, 217, 219, 223, 228, 229, 230, 231, 234, 235, 237, 241, 243, 244, 246, 251, 252, 254, 258, 259, 264, 269, 270, 271, 275, 279, 282, 288, and 291.

3. The purified polypeptide of claim 1 wherein the polypeptide comprises residues 11132-11721 of SEQ ID NO:162.

4. The purified polypeptide of claim 1 wherein the polypeptide is not generated by proteolytic or chemical cleavage of native CA125.

5. The purified polypeptide of claim 1 wherein the polypeptide comprises a fragment of CA125 selected from the group consisting of
   (ii) repeat units 1-7, 10-13, 15-19, and 21-60 of Table 16.

6. The purified polypeptide of claim 5 wherein the polypeptide is not generated by proteolytic or chemical cleavage of native CA125.

7. The purified polypeptide of claim 1 wherein the polypeptide does not comprise SEQ ID NO:162.

8. The purified polypeptide of claim 3 wherein the polypeptide comprises residues 10999-11721 of SEQ ID NO:162.

9. The purified polypeptide of claim 3 wherein the polypeptide comprises residues 10843-11721 of SEQ ID NO:162.

10. The purified polypeptide of claim 5 wherein the polypeptide comprises at least two repeat units selected from the group consisting of repeat units 1-7, 10-13, 15-19, and 21-60 of Table 16.

11. The purified polypeptide of claim 5 wherein the polypeptide comprises residues 1-314 of SEQ ID NO:146.

* * * * *

UNITED STATES PATENT AND TRADEMARK OFFICE
CERTIFICATE OF CORRECTION

PATENT NO. : 8,124,728 B2
APPLICATION NO. : 10/475117
DATED : February 28, 2012
INVENTOR(S) : Timothy O'Brien et al.

Page 1 of 1

It is certified that error appears in the above-identified patent and that said Letters Patent is hereby corrected as shown below:

Claim 1, Column 407, line 13, "comprise of" should read --comprise or--

Signed and Sealed this
First Day of May, 2012

David J. Kappos
*Director of the United States Patent and Trademark Office*